(12) United States Patent
Cigan et al.

(10) Patent No.: US 12,428,645 B2
(45) Date of Patent: *Sep. 30, 2025

(54) METHODS FOR PRODUCING GENETIC MODIFICATIONS IN A PLANT GENOME WITHOUT INCORPORATING A SELECTABLE TRANSGENE MARKER, AND COMPOSITIONS THEREOF

(71) Applicants: CORTEVA AGRISCIENCE LLC, Indianapolis, IN (US); PIONEER HI-BRED INTERNATIONAL, INC., Johnston, IA (US)

(72) Inventors: Andrew Mark Cigan, Madison, WI (US); Saverio Carl Falco, Wilmington, DE (US); Michael Lassner, Portland, OR (US); Zhan-Bin Liu, Clive, IA (US); Sergei Svitashev, Johnston, IA (US)

(73) Assignees: PIONEER HI-BRED INTERNATIONAL, INC., IA (US); CORTEVA AGRISCIENCE LLC, IN (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/355,529

(22) Filed: Jul. 20, 2023

(65) Prior Publication Data
US 2024/0084318 A1 Mar. 14, 2024

Related U.S. Application Data

(63) Continuation of application No. 14/913,607, filed as application No. PCT/US2014/051781 on Aug. 20, 2014, now Pat. No. 11,773,400.

(60) Provisional application No. 62/023,239, filed on Jul. 11, 2014, provisional application No. 61/953,090, filed on Mar. 14, 2014, provisional application No. 61/937,045, filed on Feb. 7, 2014, provisional application No. 61/882,532, filed on Sep. 25, 2013, provisional application No. 61/868,706, filed on Aug. 22, 2013.

(51) Int. Cl.
| | |
|---|---|
| C12N 15/82 | (2006.01) |
| C12N 15/00 | (2006.01) |
| C12N 15/63 | (2006.01) |
| A01H 1/00 | (2006.01) |

(52) U.S. Cl.
CPC ......... *C12N 15/8216* (2013.01); *C12N 15/00* (2013.01); *C12N 15/63* (2013.01); *C12N 15/8213* (2013.01); *C12N 15/8247* (2013.01); *C12N 15/8274* (2013.01); *A01H 1/00* (2013.01)

(58) Field of Classification Search
None
See application file for complete search history.

(56) References Cited

U.S. PATENT DOCUMENTS

| | | |
|---|---|---|
| 5,036,006 A | 7/1991 | Sanford et al. |
| 5,639,947 A | 6/1997 | Hiatt et al. |
| 5,959,177 A | 9/1999 | Hein et al. |
| 6,410,329 B1 | 6/2002 | Hansen et al. |
| 6,518,485 B1 | 2/2003 | Connett-Porceddu et al. |
| 6,603,061 B1 | 8/2003 | Armstrong et al. |
| 6,627,797 B1 | 9/2003 | Duvick et al. |
| 7,262,055 B2 | 8/2007 | Choo et al. |
| 7,868,149 B2 | 1/2011 | Boukharov et al. |
| 8,012,752 B2 | 9/2011 | Jayakumar et al. |
| 8,124,860 B2 | 2/2012 | Gallie et al. |
| 8,575,424 B2 | 11/2013 | Yau et al. |
| 8,581,036 B2 | 11/2013 | Samboju et al. |
| 8,586,361 B2 | 11/2013 | Tao et al. |
| 8,609,420 B2 | 12/2013 | Samuel et al. |
| 8,653,327 B2 | 2/2014 | Samboju et al. |
| 8,680,366 B2 | 3/2014 | Eudes et al. |

(Continued)

FOREIGN PATENT DOCUMENTS

| | | |
|---|---|---|
| CN | 103667338 A | 3/2014 |
| DE | 102015006335 A1 | 11/2016 |

(Continued)

OTHER PUBLICATIONS

Dale E.C., et al., "Intra- and Intramolecular Site-Specific Recombination in Plant Cells Mediated by Bacteriophage P1 Recombinase," Gene, Jul. 2, 1990, Accepted on Mar. 12, 1990, vol. 91, Issue. 1, pp. 79-85.

Damm B., et al., "Efficient Transformation of *Arabidopsis thaliana* Using Direct Gene Transfer to Protoplasts," Mol. Gen. Genet., May 1989, vol. 217, No. 1, pp. 6-12.

(Continued)

*Primary Examiner* — Cynthia E Collins

(57) ABSTRACT

Compositions and methods are provided for genome modification of a target sequence in the genome of a plant or plant cell, without incorporating a selectable transgene marker. The methods and compositions employ a guide polynucleotide/Cas endonuclease system to provide an effective system for modifying or altering target sites within the genome of a plant, plant cell or seed, without incorporating a selectable transgene marker. Once a genomic target site is identified, a variety of methods can be employed to further modify the target sites such that they contain a variety of polynucleotides of interest. Breeding methods and methods for selecting plants utilizing a guide polynucleotide/Cas endonuclease system are also disclosed. Compositions and methods are also provided for editing a nucleotide sequence in the genome of a cell, without incorporating a selectable transgene marker.

6 Claims, 46 Drawing Sheets

Figure 2A:
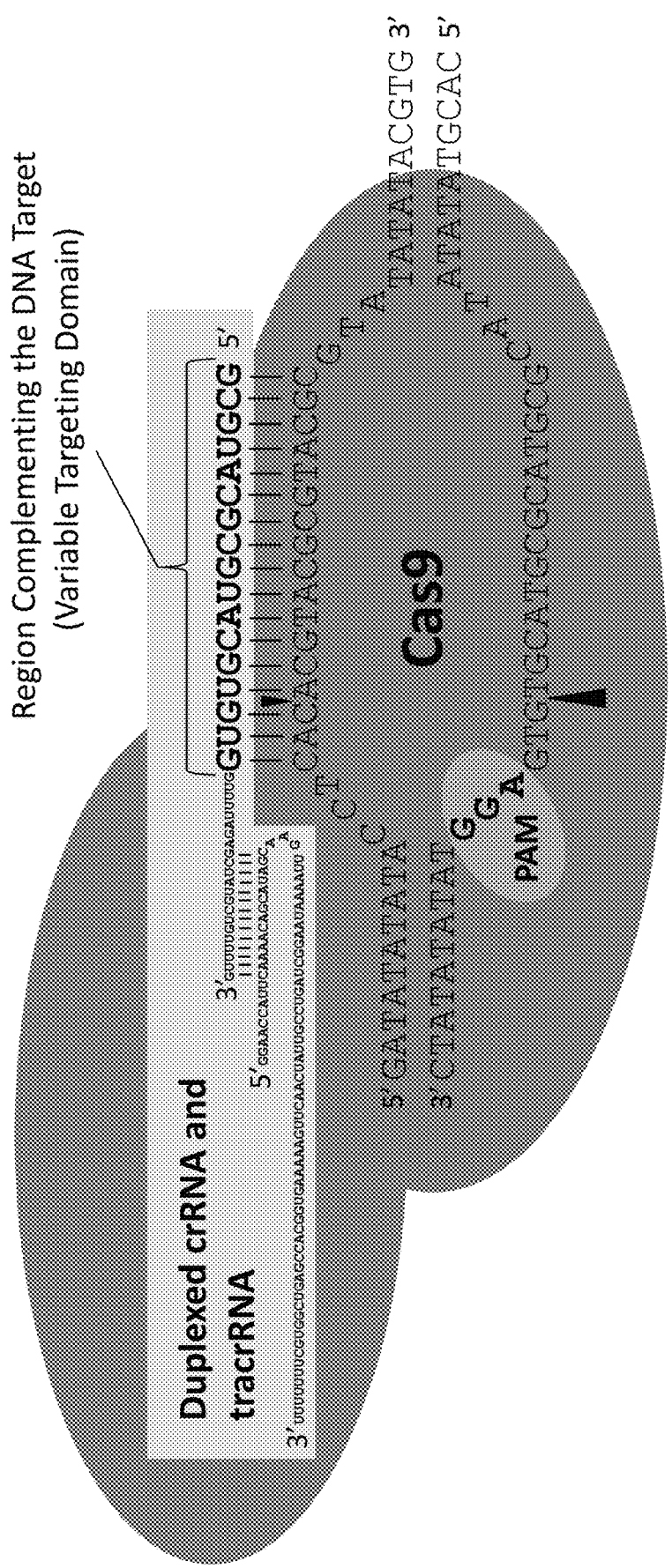

Specification includes a Sequence Listing.

(56) References Cited

U.S. PATENT DOCUMENTS

| | | |
|---|---|---|
| 8,697,359 B1 | 4/2014 | Zhang |
| 8,722,410 B2 | 5/2014 | Samuel et al. |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,163,284 B2 | 10/2015 | Liu et al. |
| 9,187,755 B2 | 11/2015 | Samuel et al. |
| 9,382,548 B2 | 7/2016 | Eudes et al. |
| 9,476,057 B2 | 10/2016 | Samuel et al. |
| 9,493,782 B2 | 11/2016 | Cigan et al. |
| 9,518,266 B2 | 12/2016 | Bruce et al. |
| 9,719,108 B2 | 8/2017 | Samuel et al. |
| 9,840,713 B2 | 12/2017 | Zhang |
| 9,885,033 B2 | 2/2018 | Joung et al. |
| 10,113,162 B2 | 10/2018 | Mathis et al. |
| 10,227,576 B1 | 3/2019 | Cameron et al. |
| 10,287,594 B2 | 5/2019 | Beetham et al. |
| 10,329,547 B1 | 6/2019 | Cameron et al. |
| 10,519,457 B2 | 12/2019 | Li et al. |
| 10,557,146 B2 | 2/2020 | Gao et al. |
| 10,870,859 B2 | 12/2020 | Li et al. |
| 11,427,830 B2 | 8/2022 | Li et al. |
| 11,773,400 B2 * | 10/2023 | Cigan ................ C12N 15/8213 800/278 |
| 12,054,725 B2 | 8/2024 | Li et al. |
| 2004/0034888 A1 | 2/2004 | Liu et al. |
| 2004/0231016 A1 | 11/2004 | Wang et al. |
| 2004/0235099 A1 | 11/2004 | Payne et al. |
| 2007/0083945 A1 | 4/2007 | Byrum et al. |
| 2007/0178593 A1 | 8/2007 | Miller et al. |
| 2007/0199095 A1 | 8/2007 | Allen et al. |
| 2008/0047031 A1 | 2/2008 | Tao et al. |
| 2009/0070891 A1 | 3/2009 | Foley et al. |
| 2009/0100536 A1 | 4/2009 | Adams et al. |
| 2009/0104700 A1 | 4/2009 | Samuel et al. |
| 2009/0111186 A1 | 4/2009 | Held et al. |
| 2009/0133152 A1 | 5/2009 | Lyznik et al. |
| 2010/0076057 A1 | 3/2010 | Sontheimer et al. |
| 2010/0159598 A1 | 6/2010 | Jayakumar et al. |
| 2010/0311168 A1 | 12/2010 | Samuel et al. |
| 2010/0313293 A1 | 12/2010 | Albertsen et al. |
| 2011/0035836 A1 | 2/2011 | Eudes et al. |
| 2011/0165679 A1 | 7/2011 | Gordon-Kamm et al. |
| 2011/0203012 A1 | 8/2011 | Dotson et al. |
| 2011/0247100 A1 | 10/2011 | Samboju et al. |
| 2012/0023619 A1 | 1/2012 | Samboju et al. |
| 2012/0023620 A1 | 1/2012 | Yau et al. |
| 2012/0244569 A1 | 9/2012 | Samuel et al. |
| 2013/0011828 A1 | 1/2013 | Barrangou et al. |
| 2013/0157369 A1 | 6/2013 | Miller |
| 2013/0198888 A1 | 8/2013 | Falco et al. |
| 2013/0263324 A1 | 10/2013 | Lassner et al. |
| 2013/0326725 A1 | 12/2013 | Shukla et al. |
| 2014/0020131 A1 | 1/2014 | Bidney et al. |
| 2014/0068797 A1 | 3/2014 | Doudna et al. |
| 2014/0090113 A1 | 3/2014 | Cogan et al. |
| 2014/0096284 A1 | 4/2014 | Martin-Ortigosa et al. |
| 2014/0179006 A1 | 6/2014 | Zhang |
| 2014/0179770 A1 | 6/2014 | Zhang et al. |
| 2014/0182012 A1 | 6/2014 | Eudes et al. |
| 2014/0186843 A1 | 7/2014 | Zhang et al. |
| 2014/0186919 A1 * | 7/2014 | Zhang .................. C12N 15/86 435/320.1 |
| 2014/0186958 A1 | 7/2014 | Zhang et al. |
| 2014/0189896 A1 | 7/2014 | Zhang et al. |
| 2014/0196170 A1 | 7/2014 | Qiao et al. |
| 2014/0223606 A1 | 8/2014 | Bermudez et al. |
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0242702 A1 | 8/2014 | Chen et al. |
| 2014/0242703 A1 | 8/2014 | Samuel et al. |
| 2014/0248702 A1 | 9/2014 | Zhang et al. |
| 2014/0256046 A1 | 9/2014 | Zhang et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0273235 A1 | 9/2014 | Voytas et al. |
| 2014/0310830 A1 | 10/2014 | Zhang et al. |
| 2014/0335620 A1 | 11/2014 | Zhang et al. |
| 2014/0342456 A1 | 11/2014 | Mali et al. |
| 2014/0357530 A1 | 12/2014 | Zhang et al. |
| 2014/0370558 A1 | 12/2014 | Mathis et al. |
| 2015/0020223 A1 | 1/2015 | Zhang et al. |
| 2015/0044191 A1 | 2/2015 | Liu et al. |
| 2015/0044772 A1 | 2/2015 | Zhao |
| 2015/0059010 A1 | 2/2015 | Cigan et al. |
| 2015/0067922 A1 * | 3/2015 | Yang .................. C12N 15/8289 435/468 |
| 2015/0079681 A1 | 3/2015 | Zhang |
| 2015/0082478 A1 | 3/2015 | Cigan et al. |
| 2015/0167000 A1 | 6/2015 | Voytas et al. |
| 2015/0167009 A1 | 6/2015 | D'Halluin |
| 2015/0184171 A1 | 7/2015 | D'Halluin |
| 2015/0225734 A1 | 8/2015 | Voytas et al. |
| 2015/0284727 A1 | 10/2015 | Kim et al. |
| 2015/0291967 A1 * | 10/2015 | Mathis ............... C12N 15/8209 800/300 |
| 2016/0024524 A1 | 1/2016 | Joung et al. |
| 2016/0032297 A1 | 2/2016 | Deschamps et al. |
| 2016/0145631 A1 | 5/2016 | Voytas et al. |
| 2016/0168592 A1 | 6/2016 | Church et al. |
| 2016/0201072 A1 | 7/2016 | Cigan et al. |
| 2016/0208271 A1 | 7/2016 | Cigan et al. |
| 2016/0208272 A1 | 7/2016 | Cigan et al. |
| 2016/0251667 A1 | 9/2016 | Cigan et al. |
| 2016/0289691 A1 * | 10/2016 | Beetham .................. C12N 9/22 |
| 2016/0304846 A1 | 10/2016 | Liu et al. |
| 2016/0340746 A1 | 11/2016 | Makarov et al. |
| 2017/0022521 A1 | 1/2017 | Samuel et al. |
| 2017/0029880 A1 | 2/2017 | Fang et al. |
| 2017/0166912 A1 | 6/2017 | Brower-Toland et al. |
| 2017/0183677 A1 | 6/2017 | Gao et al. |
| 2018/0002715 A1 | 1/2018 | Cigan et al. |
| 2018/0057832 A1 | 3/2018 | Li |
| 2018/0087104 A1 | 3/2018 | Joung et al. |
| 2018/0142263 A1 | 5/2018 | May et al. |
| 2018/0163203 A1 | 6/2018 | Bennett et al. |
| 2018/0230476 A1 | 8/2018 | Cigan et al. |
| 2018/0258417 A1 | 9/2018 | Cigan et al. |
| 2018/0258438 A1 | 9/2018 | Chaky et al. |
| 2018/0273960 A1 | 9/2018 | Cigan et al. |
| 2018/0282763 A1 | 10/2018 | Cigan et al. |
| 2018/0327785 A1 | 11/2018 | Cigan et al. |
| 2018/0346895 A1 | 12/2018 | Cigan et al. |
| 2018/0371479 A1 | 12/2018 | Cigan et al. |
| 2019/0040405 A1 | 2/2019 | Cigan et al. |
| 2019/0100745 A1 | 4/2019 | Cigan et al. |
| 2019/0100762 A1 | 4/2019 | Cigan et al. |
| 2019/0136248 A1 | 5/2019 | Cigan et al. |
| 2019/0161742 A1 | 5/2019 | Cigan et al. |
| 2019/0264232 A1 | 8/2019 | Hou et al. |
| 2019/0376074 A1 | 12/2019 | Li et al. |
| 2020/0063151 A1 | 2/2020 | Li et al. |
| 2020/0157554 A1 | 5/2020 | Cigan et al. |
| 2022/0177900 A1 | 6/2022 | Cigan et al. |
| 2022/0364107 A1 | 11/2022 | Gao et al. |
| 2023/0193304 A1 | 6/2023 | Li et al. |
| 2023/0235345 A1 | 7/2023 | Cigan et al. |
| 2023/0279413 A1 | 9/2023 | Cigan et al. |

(56) References Cited

U.S. PATENT DOCUMENTS

| | | |
|---|---|---|
| 2023/0323374 A1 | 10/2023 | Cigan et al. |
| 2024/0318192 A1 | 9/2024 | Li et al. |

FOREIGN PATENT DOCUMENTS

| | | |
|---|---|---|
| WO | 2005049842 A2 | 6/2005 |
| WO | 2007025097 A2 | 3/2007 |
| WO | 2007084294 A2 | 7/2007 |
| WO | 2009042164 A1 | 4/2009 |
| WO | 2010011961 A2 | 1/2010 |
| WO | 2010011961 A3 | 6/2010 |
| WO | 2010077319 A1 | 7/2010 |
| WO | 2011143124 A2 | 11/2011 |
| WO | 2012129373 A2 | 9/2012 |
| WO | 2012164565 A1 | 12/2012 |
| WO | 2013019411 A1 | 2/2013 |
| WO | 2013066423 A2 | 5/2013 |
| WO | 2013066805 A1 | 5/2013 |
| WO | 2013068845 A2 | 5/2013 |
| WO | 2013098244 A1 | 7/2013 |
| WO | 2013112686 A1 | 8/2013 |
| WO | 2013138363 A2 | 9/2013 |
| WO | 2013141680 A1 | 9/2013 |
| WO | 2013142578 A1 | 9/2013 |
| WO | 2013173535 A2 | 11/2013 |
| WO | 2013176772 A1 | 11/2013 |
| WO | 2014004487 A1 | 1/2014 |
| WO | 2014018423 A2 | 1/2014 |
| WO | 2014039872 A1 | 3/2014 |
| WO | 2014065596 A1 | 5/2014 |
| WO | 2014071006 A1 | 5/2014 |
| WO | 2014089290 A1 | 6/2014 |
| WO | 2014093479 A1 | 6/2014 |
| WO | 2014093595 A1 | 6/2014 |
| WO | 2014093635 A1 | 6/2014 |
| WO | 2014093694 A1 | 6/2014 |
| WO | 2014093712 A1 | 6/2014 |
| WO | 2014093768 A1 | 6/2014 |
| WO | 2014144155 A1 | 9/2014 |
| WO | 2014144288 A1 | 9/2014 |
| WO | 2014144761 A2 | 9/2014 |
| WO | 2014150624 A1 | 9/2014 |
| WO | 2014164466 A1 | 10/2014 |
| WO | 2014165825 A2 | 10/2014 |
| WO | 2014186686 A2 | 11/2014 |
| WO | 2014194190 A1 | 12/2014 |
| WO | 2015006294 A2 | 1/2015 |
| WO | 2015006747 A2 | 1/2015 |
| WO | 2015026883 A1 | 2/2015 |
| WO | 2015026885 A1 | 2/2015 |
| WO | 2015026886 A1 | 2/2015 |
| WO | 2015026887 A1 | 2/2015 |
| WO | 2015070083 A1 | 5/2015 |
| WO | 2015071474 A2 | 5/2015 |
| WO | 2015112896 A2 | 7/2015 |
| WO | 2015131101 A1 | 9/2015 |
| WO | 2015112896 A9 | 11/2015 |
| WO | 2015189693 A1 | 12/2015 |
| WO | 2016007347 A1 | 1/2016 |
| WO | 2016033298 A1 | 3/2016 |
| WO | 2016040030 A1 | 3/2016 |
| WO | 2016149352 A1 | 9/2016 |
| WO | 2016186946 A1 | 11/2016 |
| WO | 2017015015 A1 | 1/2017 |
| WO | 2017034971 A1 | 3/2017 |
| WO | 2017062855 A1 | 4/2017 |
| WO | 2017066497 A2 | 4/2017 |
| WO | 2017070032 A1 | 4/2017 |
| WO | 2017117395 A1 | 7/2017 |
| WO | 2017132239 A1 | 8/2017 |
| WO | 2017155714 A1 | 9/2017 |
| WO | 2017155715 A1 | 9/2017 |
| WO | 2017155717 A1 | 9/2017 |
| WO | 2017212264 A1 | 12/2017 |
| WO | 2017218185 A1 | 12/2017 |
| WO | 2018172556 A1 | 9/2018 |
| WO | 2018197495 A1 | 11/2018 |
| WO | 2018197520 A1 | 11/2018 |
| WO | 2019074841 A1 | 4/2019 |
| WO | 2019084148 A1 | 5/2019 |
| WO | 2019089808 A1 | 5/2019 |
| WO | 2019168953 A1 | 9/2019 |
| WO | 2019177978 A1 | 9/2019 |
| WO | 2019217354 A1 | 11/2019 |
| WO | 2019217358 A1 | 11/2019 |
| WO | 2019217816 A1 | 11/2019 |

OTHER PUBLICATIONS

Database: "Cas9-CRISPR-Associated Endonuclease CAs9," Bacillus Cereus VD131—Cas9 Gene & Protein, UniProt Database Entry: R8LDU5, Apr. 15, 2019, 3 Pages.

Database: "CRISPR-Associated Endonuclease Cas9," Lactobacillus Salivarius (Strain UCC118): Q1WVK1_LACS1, UniProt, May 2, 2006, 2 Pages.

Database ENA: "Brevibacillus Laterosporus GI-9 HNH Endonuclease Family Protein," Database Accession No. CCF15452, 2012, XP002788584, Retrieved from EBI.

Database: "Using Cpf1 for CRISPR," Benchling, Jan. 1, 2015, 4 Pages, Retrieved from URL: https://benchling.com/pub/cpf1, XP55396832.

Decision of EP Opposition Decision for EP3036327, Feb. 2020, 8 Pages.

Deltcheva E., et al., "CRISPR RNA Maturation by Trans-Encoded Small RNA and Host Factor RNase III," Mature, Mar. 31, 2011, vol. 471, No. 7340, pp. 602-607, Supplementary tables 22 Pages, Supplementary Figures 35 Pages, DOI:10.1038/nature09886, ISSN 00280836, XP055068535.

Deng W., et al., "A Novel Method for Induction of Plant Regeneration Via Somatic Embryogenesis," Plant Science, Elsevier Ireland Limited, IE, Jul. 1, 2009, vol. 177, No. 1, pp. 43-48, DOI:10.1016/J.PLANTSCI.2009.03.009, ISSN 0168-9452, XP026115501.

Deyle D.R., et al., "Adeno-Associated Virus Vector Integration," Current Opinion in Molecular Therapeutics, Aug. 2009, vol. 11, No. 4, pp. 442-447.

D'Halluin K., et al., "Targeted Molecular Trait Stacking in Cotton Through Targeted Double-strand Break Induction," Plant Biotechnology Journal, Jun. 18, 2013, vol. 11, pp. 933-941.

Dicarlo J.E., et al., Genome Engineering in *Saccharomyces cerevisiae* using CRISPR-Cas systems, Nucleic Acids Research, Mar. 4, 2013, vol. 41, No. 7, pp. 4336-4343.

Djukanovic V., et al.,"Male-Sterile Maize Plants Produced by Targeted Mutagenesis of the Cytochrome P450-like Gene (MS26) Using a Re-Designed I-Crel Homing Endonuclease," The Plant Journal, Nov. 5, 2013, vol. 76, No. 5, pp. 888-899.

Djukic M., et al., "Genome Seqence of Brevibacillus Laterosporus LMG 15441, a Pathogen of Invertebrates, "Journal of Bacteriology, American Society for Micorbiology, US, Oct. 2011, vol. 193, No. 19, pp. 5535-5536.

Dong D., et al., "The Crystal Structure of Cpf1 in complex with CRISPR RNA," Nature, 2016, 16 pages, doi:10.1038/nature17944.

Dong O.X., et al., "Targeted DNA Insertion in Plants," The Proceedings of the National Academy of Sciences, Apr. 30, 2021, vol. 118 No. 22, e2004834117, 9 Pages.

Doudna J.A., et al., "The New Frontier of Genome Engineering with CRISPR-Cas9," Science, Nov. 24, 2014, vol. 346, No. 6213, 11 Pages.

Dow L.E., et al., "Inducible in Vivo Genome Editing with CRISPR-Cas9," Nature Biotechnology, Apr. 2005, vol. 33, No. 4, pp. 390-394, EPublished on Feb. 18, 2015.

Dudas A., et al., "DNA Double-Strand Break Repair by Homologous Recombination," Mutation Research, Mar. 2004, vol. 566, No. 2, pp. 131-167.

Durai S., et al., "Zinc Finger Nucleases: Custom-Designed Molecular Scissors for Genome Engineering of Plant and Mammalian cells," Nucleic Acids Research, 2005, vol. 33, No. 18, pp. 5978-5990.

(56) References Cited

OTHER PUBLICATIONS

Ellegaard K.M., et al., "Extensive Intra-phylotype Diversity in Lactobacilli and Bifidobacteria from the Honeybee Gut," BMC Genomics, Apr. 2015, vol. 16, No. 1, Article No. 284, 22 pages.
Endo A., et al., "Efficient Targeted Mutagenesis of Rice and Tobacco Genomes Using Cpf1 From Francisella Novicida," Nature Scientific Reports, 2016, vol. 6, 38169, 9 pages.
Endo M., et al., "Toward Establishing an Efficient and Versatile Gene Targeting System in Higher Plants," Biocatalysis and Agricultural Biotechnology, 2014, vol. 3, pp. 2-6.
EP Opposition EP3036327, Cited Documents List, 1 Page.
EP Opposition Response EP3036327.
EP Summons to Oral Proceedings EP3036327, Nov. 9, 2020, 12 Pages.
Esvelt K.M., et al., "Orthogonal Cas9 Proteins for RNA-guided Gene Regulation and Editing," Nature Methods, Sep. 29, 2013, vol. 10, No. 11, pp. 1116-1121.
Esvelt K.M., "Genome-Scale Engineering for Systems and Synthetic Biology," Molecular System Biology, Jan. 22, 2013, vol. 9, No. 641, pp. 1-17, XP055339996.
Extended European Search Report for European Application No. 18209296.5, mailed Feb. 12, 2019, 8 pages.
Extended European Search Report for European Application No. 19199945.7, mailed Jan. 14, 2020, 6 pages.
Fagerlund R.D., et al., "The Cpf1 CRISPR-Cas Protein Expands Genome-Editing tools," Genome Biology, 2015, vol. 16, pp. 251-253.
Farrell ., "The Regulation of Gene Expression in Plants and Animals," In Regulation of Gene Expression in Plants, 2007, pp. 1-38.
Feng Z., et al., "Efficient Genome Editing in Plants Using a CRISPR/Cas system," Cell Research, Oct. 2013, vol. 23, No. 10, pp. 1229-1232.
Fichtner F., et al., "Precision Genetic Modifications: a New Era in Molecular Biology and Crop Improvement," Planta, 2014, vol. 239, pp. 921-939.
Florez S.L., et al., "Enhanced Somatic Embryogenesis in Theobroma Cacao using the Homologous Baby Boom Transcription factor," BMC Plant Biology, 2015, vol. 15, No. 121, 13 pages.
Fonfara I., et al., "The CRISPR-Associated DNA-Cleaving Enzyme Cpf1 also Processes Precursor CRISPR RNA," Nature, Published: Apr. 20, 2016, Issue Date: Apr. 28, 2016, vol. 532, pp. 517-521, 19 pages.
Fraley R.T., et al., "Expression of Bacterial Genes in Plant Cells," Proceedings of the National Academy of Sciences of the United States of America, Aug. 1983, vol. 80, pp. 4803-4807.
Friedland A.E., et al., "Heritable Genome Editing in *C. elegans* via a CRISPR-Cas9 system," Nature Methods, Epub Jun. 30, 2013, Aug. 2013, vol. 10, No. 8, pp. 741-743, 13 pages.
Fu Y., et al., "Improving CRISPR-Cas Nuclease Specificity Using Truncated Guide RNAs," Nature Biotechnology, Mar. 2014, vol. 32, No. 3, 9 Pages.
Fujita J., et al., "The Point Mutation in the Promoter Region and the Single Nucleotide Polymorphism in Exon 1 of the Cytokeratin 19 Gene in Human Lung Cancer Cell Lines," Lung Cancer, Dec. 2001, vol. 34, No. 3, pp. 387-394.
Funke T., et al., "Structural Basis of Glyphosate Resistance Resulting from the Double Mutation Thr 97 lle and Pro101 Ser in 5-Enolpyruvylshikimate-3-Phosphate Synthase from *Escherichia coli*," Journal of Biological Chemistry, Apr. 10, 2009, vol. 284, No. 15 pp. 9854-9860.
Gabriel R., et al., "An Unbiased Genome-Wide Analysis of Zinc-Finger Nuclease Specificity," Nature Biotechnology, Sep. 2011, vol. 29, No. 9, pp. 816-823.
Gaj T., et al., "ZFN, TALEN, and CRISPR/Cas-Based Methods for Genome Engineering," Trends in Biotechnology, Elsevier Publications, Cambridge, GB, May 9, 2013, vol. 31, No. 7, pp. 397-405, DOI:10.1016/J.TIBTECH.2013.04.004, ISSN 0167-7799, XP028571313.
Ganal W.M., et al.; "A Large Maize (*Zea mays* L.) Snp Genotyping Array: Development and Germplasm Genotyping and Genetic Mapping to Compare with the B73 Reference Genome," PLOS One, Dec. 2011, vol. 6, Issue 12 (e28334), 15 Pages.
Gao F., et al., "DNA-Guided Genome Editing Using the Natronobacterium *Gregoryi argonaute*," Nature Biotechnology, Published on May 2, 2016, DOI:10.1038/nbt.3547, 7 Pages.
Gao H., et al., "Heritable Targeted Mutagenesis in Maize using a Designed Endonuclease," The Plant Journal, Epub Oct. 7, 2009, Jan. 2010, vol. 61 (1) pp. 176-187.
Gardlik R., et al., "Vectors and Delivery Systems in Gene Therapy," Medical Science Monitor, 2005, vol. 11, No. 4, pp. RA110-RA121, 13 Pages.
Garneau J.E., et al., "The CRISPR/Cas Bacterial Immune System Cleaves Bacteriophage and Plasmid DNA," Nature, Nov. 4, 2010, vol. 468, pp. 67-71, 6 pages.
Garside E.L., et al., "Cas5d Processes Pre-crRNA and is a Member of a Larger Family of CRISPR RNA Endonucleases," RNA, 2012, vol. 18, No. 11, pp. 2020-2028.
Gasiunas G., et al., "Cas9-crRNA Ribonucleoprotein Complex Mediates Specific DNA Cleavage for Adaptive Immunity in Bacteria," Proceedings of the National Academy of Sciences, National Academy of Sciences, Sep. 25, 2012, vol. 109, No. 39, pp. E2579-E2586, DOI:10.1073/pnas.1208507109, ISSN 0027-8424, XP055069955, EPublished on Sep. 4, 2012.
Luo K., et al., "GM-Gene-Deletor: Fused loxP-FRT Recognition Sequences Dramatically Improve the Efficiency of FLP or CRE Recombinase on Transgene Excision from Pollen and Seed of Tobacco Plants," Plant Biotechnology Journal, Mar. 2007, vol. 5, No. 2, pp. 263-274.
Luo S., et al., "Non-Transgenic Plant Genome Editing Using Purified Sequence-Specific Nucleases," Molecular Plant, Jun. 11, 2015, Sep. 2015, vol. 8, pp. 1425-1427.
Lyznik L.A., et al., "Activity of Yeast FLP Recombinase in Maize and Rice Protoplasts," Nucleic Acids Research, 1993, vol. 21, No. 4, pp. 969-975.
Ma M., et al., "A Guide RNA Sequence Design Platform for the CRISPR/Cas9 System for Model Organism Genomes," BioMed Research International, 2013, vol. 2013, Article ID 270805, 4 Pages.
Maeder M.L., et al., "CRISPR RNA-guided Activation of Endogenous Human Genes," Nature Methods, Oct. 2013, vol. 10, No. 10, pp. 977-979.
Maeser S., et al., "The Gin Recombinase of Phage Mu can Catalyse Site-Specific Recombination in Plant Protoplasts," Molecular and General Genetics, Nov. 1991, vol. 230(1-2), pp. 170-176.
Maier L-K., et al., "An Active Immune Defense with a Minimal CRISPR (Clustered Regularly Interspaced Short Palindromic Repeats) RNA and without the Cas6 Protein," The Journal of Biological Chemistry, Feb. 13, 2015, vol. 290, No. 7, pp. 4192-4201, 11 Pages.
Makarova K.S., et al., "An Updated Evolutionary Classification of CRISPR-Cas Systems," Nature Reviews Microbiology, Nov. 2015, vol. 13, 15 Pages, DOI:10.1038/nrmicro3569.
Makarova K.S., et al., "Evolution and Classification of the CRISPR-Cas Systems," Nature Reviews Microbiology, Jun. 2011, vol. 9, No. 6, pp. 467-477, 23 Pages.
Makarova K.S., et al., "The Basic Building Blocks and Evolution of CRISPR-CAS Systems," Biochemical Society Transactions, 2013, vol. 41, No. 6, pp. 1392-1400 (and Supplemental).
Mali P., et al., "CAS9 Transcriptional Activators for Target Specificity Screening and Paired Nickases for Cooperative Genome Engineering," Nature Biotechnology, Sep. 2013, vol. 31, No. 9, pp. 833-838, 17 pages.
Mali P., et al., "RNA-guided Human Genome Engineering Via Cas9," Science, Feb. 15, 2013, vol. 339, No. 6121, pp. 823-826, 8 Pages.
Malina A., et al., "Repurposing CRISPR/Cas9 for in Situ Functional Assays," Genes & Development, 2013, vol. 27, pp. 2602-2614 DOI:10.1101/gad.227132.113, XP055177303.
Mandal P.K., et al., "Efficient Ablation of Genes in Human Hematopoietic Stem and Effector Cells Using CRISPR/ Cas9," Cell Stem Cell, Nov. 6, 2014, vol. 15, No. 5, pp. 643-652.
Mao Y., et al., "Application of the CRISPR-Cas System for Efficient Genome Engineering in Plants," Letter to the Editor, Molecular Plant, Nov. 2013, vol. 6, No. 6, pp. 2008-2011.

(56) References Cited

OTHER PUBLICATIONS

Mao Z., et al., "Comparison of Nonhomologous End Joining and Homologous Recombination in Human Cells," DNA Repair, 2008, vol. 7, pp. 1765-1771.

Marraffini L.A., et al., "CRISPR Interference Limits Horizontal Gene Transfer in *Staphylococci* by Targeting DNA," Science, Dec. 19, 2008, vol. 322, No. 5909, pp. 1843-1845, 7 pages.

Marraffini L.A., et al., "CRISPR Interference: RNA-directed Adaptive Immunity in Bacteria and Archaea," Nature Review Genetics, Mar. 2010, vol. 11, No. 3, pp. 181-190, 23 Pages.

Martin-Ortigosa S., et al., "Mesoporous Silica Nanoparticle-Mediated Intracellular Cre Protein Delivery for Maize Genome Editing via loxP Site Excision 1'2[W][OPEN]," Plant Physiology, Feb. 2014, vol. 164, No. 2, pp. 537-547.

Martin-Ortigosa S., et al., "Proteolistics: A Biolistic Method for Intracellular Delivery of Proteins," Transgenic Resource, Oct. 2014, vol. 23, No. 5, pp. 743-756, DOI:10.1007/S11248-014-9807-Y, ISSN 0962-8819, XP035381272, (EPublished on Aug. 5, 2014).

Maruyama T., et al., "Corrigendum: Increasing the Efficiency of Precise Genome Editing with CRISPR-Cas9 by Inhibition of Nonhomologous End Joining," Nature Biotechnology, May 2015, vol. 33, No. 5, pp. 538-542, 9 Pages.

Matsunaga T., et al., "Single-step Generation of Gene Knockout-Rescue System in Pluripotent Stem Cells by Promoter Insertion with CRISPR/Cas9," Biochemical and Biophysical Research Communications, 2014, vol. 444, pp. 158-163, DOI:10.1016/j.bbrc.2014.01.037, XP028614859, (Published online on Jan. 22, 2014).

Miao J., et al., "Targeted Mutagenesis in Rice Using CRISPR-Cas System," Cell Research, Sep. 3, 2013, vol. 23, No. 10, pp. 1233-1236, doi:10.1038/cr.2013.123, ISSN 1001-0602, XP055153533.

Miller J.C., et al., "A TALE Nuclease Architecture for Efficient Genome Editing," Nature Biotechnology, Feb. 2011, vol. 29, No. 2, pp. 143-148.

Miller W.A., et al., "The RNA World in Plants:Post-Transcriptional Control III," The Plant Cell, 2001, vol. 13, pp. 1710-1717.

Mojica F.J., et al., "Biological Significance of a Family of Regularly Spaced Repeats in the Genomes of Archaea, Bacteria and Mitochondria," Molecular Microbiology, May 2000, vol. 36, No. 1, pp. 244-246, 4 pages.

Naito Y., et al., "CRISPRdirect: Software for Designing CRISPR/Cas Guide RNA with Reduced off-target Sites," Bioinformatics, 2015, vol. 31, No. 7, pp. 1120-1123, (Received, Revised, Accepted on 2014).

Nam K.H., et al., "Cas5d Protein Processes Pre-crRNA and Assembles into a Cascade-like Interference Complex in Subtype I-C/Dvulg CRISPR-Cas System," Structure, Sep. 5, 2012, vol. 20, pp. 1574-1584.

Natsume T., et al., "Hybridization Energies of Double Strands Composed of DNA, RNA, PNA and LNA," Chemical Physical Letters, 2007, vol. 434, pp. 133-138.

NCBI: "CRISPR-Associated Protein Cas9 [Prevotella Histicola JCM 15637 = DNF00424]," NCBIGenPept, Database Accession No. KGF29309, Jul. 9, 2014, 2 Pages. [Retrieved on Jun. 9, 2019] Retrieved from the URL: https://www.ncbi.nim.nih.gov/protein/690782330.

NCBI: "Type II CRISPR-RNA-Guided Endonuclease Cas9 [Enterococcus Faecalis]," Database RefSEQ NCBI, Database Accession No. WP_010710291.1, Oct. 7, 2015, 2 Pages.

NCBI: "Type II CRISPR-RNA-Guided Endonuclease Cas9 [Enterococcus Mundtii]," Database RefSEQ NCBI, Database Accession No. WP_023519017.1, Oct. 7, 2015, 2 Pages.

NCBI: "Type II CRISPR-RNA-Guided Endonuclease Cas9 [Flavobacterium chungangense]," Database RefSEQ NCBI, Database Accession No. WP_031455829.1, Oct. 7, 2015, 2 Pages.

NCBI: "Type II CRISPR-RNA-Guided Endonuclease Cas9 [Pseudomonas lini]," Database RefSEQ NCBI, Database Accession No. WP_048395223.1, Jul. 1, 2015, 2 Pages.

Nekrasov V., et al., "Targeted Mutagenesis In the Model Plant *Nicotiana benthamiana* Using Cas9 RNA-Guided Endonuclease," Nature Biotechnology, Aug. 2013, vol. 31, No. 8, pp. 691-693.

Nirenberg M., et al., "Historical Review: Deciphering the Genetic code—a Personal Account," Trends in Biochemical Sciences, 2003, Jan. 2004, vol. 29, No. 1, pp. 46-54.

Nishimasu H., et al., "Crystal Structure of Cas9 in Complex with Guide RNA and Target DNA," Cell, Elsevier, Amsterdam, NL, Feb. 13, 2014, vol. 156, No. 5, pp. 935-949, 23 Pages, (Accepted on Feb. 2, 2014), DOI:10.1016/j.cell.2014.02.001, ISSN 0092-8674, S1-S8, XP055423859, (Includes Supplemental Information).

Nishimasu H., et al., "Structures and Mechanisms of CRISPR RNA-Guided Effector Nucleases," Current Opinion in Structural Biology, 2017, vol. 43, pp. 68-78.

O'Brien A., et al., "GT-Scan: Identifying Unique Genomic Targets," Bioinformatics, May 23, 2014, vol. 30, No. 18, pp. 2673-2675.

Oh J-H., et al., "CRISPR-Cas9-Assisted Recombineering in Lactobacillus Reuteri," Nucleic Acids Research, Sep. 29, 2014, vol. 42, No. 17(e131), pp. 1-4, 15 Pages, (and Supplemental), DOI:10.1093/nar/gku623, ISSN 0305-1048, XP055291625 and XP055190221, [Retrieved on Jul. 27, 2016] Retrieved from URL: http://nar.oxfordjournals.org/content/suppl/2014/07/29/gku623.DC1/nar-01438-met-h-2014-File007.pdf.

Onouchi H., et al., "Operation of an Efficient Site-Specific Recombination System of *Zygosaccharomyces rouxii* in Tobacco Cells," Nucleic Acids Research, Dec. 11, 1991, vol. 19, No. 23, pp. 6373-6378.

Oost J.V.D., "New Tool for Genome Surgery," Science, Feb. 15, 2013, vol. 339, pp. 768-770, 4 Pages.

Opposition Notice for European Patent Application No. EP3036332, dated Mar. 2021.

Overbeek M.V., et al., "DNA Repair Profiling Reveals Nonrandom Outcomes at Cas9-Mediated Breaks," Molecular Cell, Elsevier, Amsterdam, NL, Aug. 18, 2016, vol. 63, No. 4, pp. 633-646, 15 Pages. Published Online Aug. 4, 2016, DOI: 10.1016/J.Molcel.2016.06.037, ISSN 1097-2765, XP029690136.

Ow D.W., "Recombinase-Mediated Gene Stacking as a Transformation Operating System," Journal of Integrative Plant Biology, 2011, vol. 53, No. 7, pp. 512-519.

P. Mali, Yang L., Esvelt K. M., Aach J., Guell M., Dicarlo J. E., Norville J. E., Church G. M., "Supplementary Materials for RNA Guided Human Genome Engineering via Cas9", Science, American Association for the Advancement of Science, US, US, (feb. 15, 2013), vol. 339, No. 6121, doi:10.1126/science.1232033, ISSN 00368075, pp. 1 36, XP055322657.

Pacher M., et al., "From Classical Mutagenesis to Nuclease-Based Breeding—Directing Natural DNA Repair for a Natural End-Product," The Plant Journal, Mar. 11, 2017, vol. 90, pp. 819-833, XP055650815.

Patrick D.H., et al., "DNA Targeting Specificity of RNA-Guided Cas9 Nucleases," Nature Biotechnology, Sep. 2013, vol. 31, No. 9, pp. 827-834.

Pattanayak V., et al., "High-Throughput Profiling of Off-Target DNA Cleavage Reveals RNA-Programmed Cas9 Nuclease Specificity," Nature Biotechnology, Published on Aug. 11, 2013, Sep. 2013, vol. 31, No. 9, pp. 839-843.

Paul J.W III., et al., "CRISPR/Cas9 for Plant Genome Editing: Accomplishments, Problems and Prospects," Plant Cell Reports, Springer International, DE, figure 4, Apr. 25, 2016, vol. 35, No. 7, pp. 1417-1427.

Zhao Y., et al., "An Alternative Strategy for Targeted Gene Replacement in Plants Using a Dual-sgRNA/Cas9 design," Nature Scientific Reports, 2016, vol. 6, p. 23890, 11 pages.

Ziemienowicz A., et al., "Import of Agrobacterium T-DNA into Plant Nuclei: Two Distinct Functions of VirD2 and VirE2 Proteins," The Plant Cell, Feb. 2001, vol. 13, pp. 369-383.

Zuris J.A., et al., "Cationic Lipid-Mediated Delivery of Proteins Enables Efficient Protein-based Genome Editing in Vitro and in Vivo," Nature Biotechnology, Published Online Oct. 30, 2014, Jan. 2015, vol. 33, No. 1, pp. 73-80.

Peng N., et al., "A Synthetic Arabinose-Inducible Promoter Confers High Levels of Recombinant Protein Expression in Hyperthermophilic Archaean *Sulfolobus islandicus*," Applied and Environmental Microbiology, Aug. 2012, vol. 78, No. 16, pp. 5630-5637.

(56) References Cited

OTHER PUBLICATIONS

Phillips A.J., "The Challenge of Gene Therapy and DNA Delivery," Journal of Pharmacy and Pharmacology, 2001, vol. 53, pp. 1169-1174.
"Plant Genome Modification Using Guide RNA/Cas Endonuclease Systems and Methods of Use," Co-Pending Related U.S. Appl. No. 14/463,687, filed Aug. 20, 2014, Abandoned Feb. 3, 2022, 262 Pages.
Podevin N., et al., "Site-directed Nucleases: A Paradigm Shift in Predictable, Knowledge-based Plant Breeding," Trends in Biotechnology, Jun. 2013, vol. 31, No. 6, pp. 375-383, DOI:10.1016/j.tibtech.2013.03.004, XP028550365, (Epublished on Apr. 17, 2013).
Puchta H., et al., "A Transient Assay in Plant Cells Reveals a Positive Correlation Between Extrachromosomal Recombination Rates and Length Of Homologous Overlap," Nucleic Acids Research, May 11, 1991, vol. 19, No. 10, pp. 2693-2700.
Puchta H., et al., "Gene Replacement by Homologous Recombination in Plants," Plant Molecular Biology, 2002, vol. 48, pp. 173-182.
Puchta H., et al., "Homologous Recombination in Plant Cells is Enhanced by In Vivo Induction of Double Strand Breaks Into DNA by a Site-Specific Endonuclease," Nucleic Acids Research, Nov. 11, 1993, vol. 21, No. 22, pp. 5034-5040.
Puchta H., et al., "Two Different but Related Mechanisms are Used in Plants for the Repair of Genomic Double-Strand Breaks by Homologous Recombination," Proceedings of the National Academy of Sciences, USA, May 14, 1996, vol. 93, No. 10, pp. 5055-5060, 7 Pages.
Puchta H., et al., "Synthetic Nucleases for Genome Engineering in Plants: Prospects for a Bright Future," The Plant Journal, 2014, vol. 78, pp. 727-741.
Qi L.S., et al., "Repurposing CRISPR as an RNA-Guided Platform for Sequence-Specific Control of Gene Expression," Cell, Feb. 28, 2013, vol. 152, No. 5, pp. 1173-1183, 22 pages.
Que Q., et al., "Maize Transformation Technology Development For Commercial Event Generation," Frontiers in Plant Science, Aug. 5, 2014, vol. 5, Article No. 379, 19 Pages, DOI:10.3389/fpls.2014.00379, XP055217826.
Que Q., et al., "Trait Stacking in Transgenic Crops Challenges and Opportunities," GM Crops, Jul.-Oct. 2010, vol. 1, No. 4, pp. 220-229.
Que Q., "Repurposing Macromolecule Delivery Tools for Plant Genetic Modification in the Era of Precision Genome Engineering," Methods and Protocols, Methods in Molecular Biology, 2019, Chapter 1, vol. 1864, 16 Pages.
Quinn T.P., et al., "A Streamlined Method for the Production, Screening, and Application of SgRNAs for CRISPR/Cas Gene Editing," Molecular Therapy, May 2014, vol. 22, Supplement 1, pp. S127-S128,(#336).
Raikhel N., "Nuclear Targeting in Plants," Plant Physiology, 1992, vol. 100, pp. 1627-1632.
Ramakrishna S., et al., "Gene Disruption by Cell-Penetrating Peptide-Mediated Delivery of Cas9 Protein and Guide RNA," Genome Research, 2014, vol. 24, No. 6, pp. 1020-1027, 9 Pages, DOI:10.1101/gr.171264.113, XP055128944.
Ramalingam S., et al., A CRISPR Way to Engineer the Human Genome, Genome Biology, Feb. 26, 2013, vol. 14, No. 107, 4 Pages.
Rath D., et al., "Type I-E CRISPR-Cas System as an Immune System in a Eukaryote," BioRxiv, 2018, 20 Pages, DOI:10.1101/357301.
Reeks J., et al., "CRISPR Interference: A Structural Perspective," Biochemical Journal, 2013, vol. 453, pp. 155-166, 17 Pages.
Relic B., et al., "Interaction of the DNA Modifying Proteins VirD1 and VirD2 of Agrobacterium Tumefaciens: Analysis by Subcellular Localization in Mammalian Cells," Proceedings of the National Academy of Sciences of the United States of America, Aug. 1998, vol. 95, pp. 9105-9110.
Ren X., et al., "Optimized Gene Editing Technology for Drosophila Melanogaster Using Germ Line-Specific Cas9," Proceedings of the National Academy of Sciences, Nov. 19, 2013, vol. 110, No. 47, pp. 19012-19017, XP055967811.
Retallack D.M., et al., "A Single-Base-Pair Mutation Changes the Specificities of Both a Transcription Activation Protein and its Binding Site," Proceedings of the National Academy of Sciences of the United States of America, Oct. 1993, vol. 90, pp. 9562-9565.
Rueda et al., "Mapping the sugar dependency for rational generation of a DNA-RNA hybrid-guided Cas9 andonuclease". Nature Communications, 2017, 8:1610, XP055688584 (and Supplemental).
Rueda F.O., et al., "Mapping the Sugar Dependency for Rational Generation of a DNA-RNA Hybrid-Guided Cas9 Endonuclease," Nature Communications, 2017, vol. 8, No. 1610, pp. 1-11, Jan. 1, 2017, XP055688584.
Rusk N., "New Kid on the CRISPR Block," Nature Methods, 2015, vol. 12, No. 12, p. 1117.
Sadowski P.D., "Site-specific Genetic Recombination: Hops, Flips, and Flops," Journal of FASEB, 1993, vol. 7, pp. 760-767.
Sanjana N.E., et al., "A Transcription Activator-Like Effector (TALE) Toolbox for Genome Engineering," Nature Protocols, 2012, vol. 7, No. 1, pp. 171-192, 39 pages.
Sanozky-Dawes R., et al., "Occurrence and Activity of a Type II CRISPR-Cas System in Lactobacillus Gasseri," Microbiology, vol. 161, No. 9, pp. 1752-1761, Sep. 1, 2015.
Sapranauskas R., et al., "The *Streptococcus* Thermophiles CRISPR/Cas System Provides Immunity in *Escherichia coli*," Nucleic Acids Research, 2011, vol. 39, No. 21, pp. 9275-9282, Supplementary Figures, Supplementary Materials and Methods, and Supplementary Tables 10 Pages, 18 Total Pages, DOI:10.1093/nar/gkr606, ISSN 0305-1048, XP055067807 & XP055265024, (EPublished online on Aug. 3, 2011).
Sauer B., "Site-Specific Recombination: Developments and Applications," Current Opinion in Biotechnology, 1994, vol. 5, pp. 521-527.
Schaeffer S.M., et al., "The Expanding Footprint of CRISPR/CAs9 in the Plant Sciences," Plant Cell Reports, Springer International, DE, Apr. 30, 2016, vol. 35, No. 7, pp. 1451-1468.
Schirle N.T., et al., "Structural Basis for MicroRNA Targeting," Science, Oct. 31, 2014, vol. 346, Issue. 6209, pp. 608-613.
Schlake T., et al., "Use of Mutated FLP Recognition Target (FRT) Sites for the Exchange of Expression Cassettes at Defined Chromosomal Loci," Biochemistry, 1994, vol. 33, No. 43, pp. 12746-12751.
Schulze S., et al., "The Development of Genome Editing Tools as Powerful Techniques with Versatile Applications in Biotechnology and Medicine: CRISPR/Cas9, ZnF and TALE Nucleases, RNA Interference, and Cre/loxP," Chem Texts, 2021, vol. 7, No. 3, 18 Pages.
Shah S.A., et al., "Protospacer Recognition Motifs," RNA Biology, May 1, 2013, vol. 10, No. 5, pp. 891-899, ISSN: 1547-6286.
Shan Q., et al., "Targeted Genome Modification of Crop Plants Using a CRISPR-Cas System," Nature Biotechnology, Aug. 1, 2013, vol. 31, No. 8, DOI: 10.1038/nbt.2650, ISSN 1087-0156, pp. 686-688, XP055153530.
Shen B., et al., "Generation of Gene-modified Mice via Cas9/RNA-Mediated Gene Targeting," Cell Research, May 2013, vol. 23, No. 5, pp. 720-723.
Shi J., et al., "ARGOS8 Variants Generated by CRISPR-Cas9 Improve Maize Grain Yield Under Field Drought Stress Conditions," Plant Biotechnology Journal, Published online Aug. 17, 2016, 2017, vol. 15, No. 2, pp. 207-216, XP002776694.
Shi J., et al., "Maize and *Arabidopsis* ARGOS Proteins Interact with Ethylene Receptor Signaling Complex, Supporting a Regulatory Role for ARGOS in Ethylene Signal Transduction [Open]," Plant Physiology, Published online Jun. 7, 2016, Aug. 2016, vol. 171, No. 4, pp. 2783-2797.
Shi J., et al., "Overexpression of ARGOS Genes Modifies Plant Sensitivity to Ethylene, Leading to Improved Drought Tolerance in Both *Arabidopsis* and Maize [Open]," Plant Physiology, Sep. 2015, vol. 169, pp. 266-282.
Shmakov S., et al., "Diversity and Evolution of Class 2 CRISPR-Cas Systems," Nature Reviews Microbiology, 2017, vol. 15, No. 3, pp. 1-14, Published Online Jan. 23, 2017.
Shou H., et al., "Assessment of Transgenic Maize Events Produced by Particle Bombardment or Agrobacterium-Mediated Transformation," Molecular Breeding, 2004, vol. 13, pp. 201-208.

(56) References Cited

OTHER PUBLICATIONS

Shukla V.K., et al., "Precise Genome Modification in the Crop Species *Zea mays* Using Zinc-finger Nucleases," Nature, May 21, 2009, vol. 459, No. 7245, pp. 437-441.
Shukla V.K., et al., "Precise Genome Modification in the Crop Species *Zea mays* Using Zinc-finger Nucleases," Nature, May 21, 2009, vol. 459, No. 7245, pp. 437-441, and Supplementary Information, Total 23 pages.
Sinkunas T., et al., "Cas3 is a Single-Stranded DNA Nuclease and ATP-Dependent Helicase in the CRISPR/Cas Immune System," The EMBO Journal, (European Molecular Biology Organization), Apr. 2011, vol. 30, No. 7, pp. 1335-1342, XP002765626.
Sinkunas T., et al., "In Vitro Reconstitution of Cascade-Mediated CRISPR Immunity in *Streptococcus thermophilus*," The EMBO Journal, 2013, vol. 32, No. 3, pp. 385-394.
Sodeinde O.A., et al., "Homologous Recombination in the Nuclear Genome of Chlamydomonas Reinhardtii," Proceedings of the National Academy of Sciences of the United States of America, Oct. 1993, vol. 90, pp. 9199-9203.
Song Q., et al., "Development and Evaluation of SoySNP50K, a High Density Genotyping Array for Soybean," PLoSONE, Jan. 25, 2013, vol. 8 No. 1, p. e54985, 12 pages.
Sontheimer E.J., et al.,"Cas9 gets a classmate," Nature Biotechnology, Dec. 2015, vol. 33, No. 12, pp. 1240-1241.
Srinivasan C., et al., "Heterologous Expression of the Baby Boom AP2/ERF Transcription Factor Enhances the Regeneration Capacity of Tobacco (*Nicotiana tabacum* L.)," Planta (Berlin), Jan. 2007, vol. 225, No. 2, pp. 341-351, DOI:10.1007/s00425-006-0358-1, ISSN: 0032-0935, XP002627488.
Gilbert L.A., et al., "CRISPR-Mediated Modular RNA-Guided Regulation of Transcription in Eukaryotes," Cell, Jul. 18, 2013, vol. 154, No. 2, pp. 442-451, 20 Pages.
Gil-Humanes J., et al., High-Efficiency Gene Targeting in Hexapioid Wheat Using DNA Replicons and CRISPR/Cas9, Plant Journal, Mar. 2017, vol. 89, No. 6, pp. 1251-1262.
Gilles A.F., et al., "Efficient CRISPR-mediated Gene Targeting and Transgene Replacement in the Beetle *Tribolium castaneum*," The Company of Biologists Limited, Development, 2015, vol. 142, pp. 2832-2839.
Glenn T.C., et al., "Field Guide to Next-Generation DNA sequencers," Molecular Ecology Resources, 2011, vol. 11, pp. 759-769.
Gong S., et al., "DNA Unwinding is the Primary Determinant of CRISPR-Cas9 Activity," Cell Reports, Jan. 9, 2018, vol. 22, Issue 9, pp. 359-371.
Gordon-Kamm W.J., et al., "Transformation of Maize Cells and Regeneration of Fertile Transgenic Plants," The Plant Cell, Jul. 1990, vol. 2, No. 7, pp. 603-618, 17 Pages.
Gratz S.J., et al., "Genome Engineering of Drosophila with the CRISPR RNA-Guided Cas9 Nuclease," Aug. 2013, Genetics, vol. 194, pp. 1029-1035, 17 Pages.
Grissa I., et al., "CRISPRFinder: A Web Tool To Identify Clustered Regularly Interspaced Short Palindromic Repeats," Nucleic Acids Research, Information Retrieval Ltd, GB, Jul. 2007, vol. 35, pp. W52-W57, Epublished on May 30, 2007.
Guerineau F., et al., "Effect of Two Consensus Sequences Preceding the Translation Initiator Codon on Gene Expression in Plant Protoplasts," Plant Molecular Biology, Feb. 1992, vol. 18, No. 4, pp. 815-818.
Guilinger J.P., et al., "Fusion of Catalytically Inactive Cas9 to FokI Nuclease Improves the Specificity of Genome Modification," Nature Biotechnology, Jun. 2014, vol. 32, No. 6, pp. 577-583.
Guilinger P., et al., "Broad Specificity Profiling of Talens Results In Engineered Nucleases With Improved DNA-Cleavage Specificity," Nature Methods, Apr. 2014, vol. 11, No. 4, pp. 429-435, (Published online on Feb. 16, 2014).
Habben J.E., et al., "Transgenic Alteration of Ethylene Biosynthesis Increases Grain Yield in Maize Under Field Drought-Stress Conditions," Plant Biotechnology Journal, 2014, vol. 12, pp. 685-693.
Haberer G., et al., "Structure and Architecture of the Maize Genome," Plant Physiology, Dec. 2005, vol. 139, pp. 1612-1624.
Haft D.H., et al., "A Guild of 45 CRISPR-Associated (Cas) Protein Families and Multiple CRISPR/Cas Subtypes Exist in Prokaryotic Genomes," PLoS Computational Biology, Nov. 2005, vol. 1, Issue 6(e60), 10 Pages.
Hale C.R., et al., "RNA-Guided RNA Cleavage by a CRISPR RNA-Cas Protein Complex," Cell, Nov. 25, 2009, vol. 139, pp. 945-956.
Harrington L.B., et al., "Programmed DNA Destruction by Miniature CRISPR-Cas14 Enzymes," Science, Nov. 16, 2018, vol. 362, pp. 839-842.
Haurwitz R.E., et al., "Sequence- and Structure-Specific RNA Processing by a CRISPR Endonuclease," Science, Sep. 10, 2010, vol. 329, pp. 1355-1358, 5 Pages.
Heler R., et al., "Cas9 Specifies Functional Viral Targets During CRISPR-Cas Adaptation," Nature, Mar. 12, 2015, vol. 519, pp. 199-202, 16 Pages.
Hicks G.R., "Nuclear Import of Plant Proteins," Madame Curie Bioscience Database, Austin (TX), 2000-2013, pp. 61-82, Retrieved from URL: https://www.ncbi.nlm.nih.gov/books/NBK6124, XP055967787.
Hiei Y., et al., "Efficient Transformation of Rice (*Oryza sativa* L.) Mediated by Agrobacterium and Sequence Analysis of the Boundaries of the T-DNA," The Plant Journal, 1994, vol. 6, No. 2, pp. 271-282.
Hinchee M.A.W., et al., "Production of Transgenic Soybean Plants Using Agrobacterium-mediated DNA Transfer," Bio/Technology, Aug. 1988, vol. 6, pp. 915-922, DOI:10.1038/nbt0888-915, XP002045224.
Hink M.A., et al., "Structural Dynamics of Green Fluorescent Protein Alone and Fused with a Single Chain Fv Protein," The Journal of Biological Chemistry, Jun. 9, 2000, vol. 275, No. 23, pp. 17556-17560.
Hochstrasser M.L., et al., "Cutting it Close: CRISPR-Associated Endoribonuclease Structure and Function," Trends in Biochemical Sciences, Jan. 2014, vol. 40, No. 1, pp. 58-66.
Horsch R.B., et al., "Inheritance of Functional Foreign Genes in Plants," Science, Feb. 3, 1984, vol. 223, No. 4635, pp. 496-498.
Horvath P., et al., "CRISPR/Cas, the Immune System of Bacteria and Archaea," Science, Jan. 8, 2010, vol. 327, pp. 167-170, 5 pages.
Horvath P., et al., "Diversity, Activity, and Evolution of CRISPR Loci in *Streptococcus thermophilus*," Journal of Bacteriology, Feb. 2008, vol. 190, No. 4, pp. 1401-1412.
Hou Z., et al., "Efficient Genome Engineering in Human Pluripotent Stem Cells using Cas9 from Neisseria Meningitidis," Proceedings of the National Academy of Sciences of the United States of America, Sep. 24, 2013, vol. 110, No. 39, pp. 15644-15649.
Houdebine L-M., "The Methods to Generate Transgenic Animals and to Control Transgene Expression," Journal of Biotechnology, 2002, vol. 98, pp. 145-160.
Hsu P.D., et al., "Development and Applications of CRISPR-Cas9 for Genome Engineering," Cell, Jun. 5, 2014, vol. 157, pp. 1262-1278.
Huang T.P., et al., "Circularly Permuted and PAM-modified Cas9 Variants Broaden the Targeting Scope of Base Editors," Nature Biotechnology, Jun. 2019, vol. 37, pp. 626-631, 9 Pages.
Husaini A.M., et al., "Vehicles and ways for Efficient Nuclear Transformation in Plants," GMCrops, 2010, vol. 1, No. 5, pp. 276-287.
Hwang W.Y., et al., "Efficient In Vivo Genome Editing Using RNA-Guided Nucleases," Nature Biotechnology, Mar. 2013, vol. 31, No. 3, pp. 227-229, 12 Pages.
Hyun Y., et al., "Site-directed Mutagenesis in *Arabidopsis thaliana* Using Dividing Tissue-Targeted RGEN of the CRISPR/Cas System to Generate Heritable Null Alleles," Planta, Jan. 2015, vol. 241, No. 1, pp. 271-284.
International Preliminary Report on Patentability for International Application No. PCT/US2014/051778, mailed Mar. 3, 2016, 8 pages.
International Preliminary Report on Patentability for International Application No. PCT/US2014/051780, mailed Mar. 3, 2016, 9 pages.

(56) References Cited

OTHER PUBLICATIONS

International Preliminary Report on Patentability for International Application No. PCT/US2014/051781, mailed Mar. 3, 2016, 8 pages.
International Preliminary Report on Patentability for International Application No. PCT/US2014/051782, mailed Mar. 3, 2016, 6 pages.
International Preliminary Report on Patentability for International Application No. PCT/US2015/040143, mailed Jan. 26, 2017, 14 pages.
International Search Report and Written Opinion for International Application No. PCT/US2014/051778, mailed Dec. 3, 2014, 13 pages.
International Search Report and Written Opinion for International Application No. PCT/US2014/051780, mailed Dec. 9, 2014, 12 pages.
International Search Report and Written Opinion for International Application No. PCT/US2014/051781, mailed Dec. 3, 2014, 12 pages.
International Search Report and Written Opinion for International Application No. PCT/US2014/051782, mailed Dec. 3, 2014, 10 pages.
International Search Report and Written Opinion for International Application No. PCT/US2015/040143, mailed Oct. 28, 2015, 17 pages.
Jacobs T.B., et al., "Targeted Genome Modifications in Soybean with CRISPR/Cas9," BMC Biotechnology, Mar. 2015, vol. 15, No. 16, 10 pages.
Jacoby K., et al., "Expanding LAGLIDADG Endonuclease Scaffold Diversity by Rapidly Surveying Evolutionary Sequence Space," Nucleic Acids Research, vol. 40, No. 11, pp. 4954-4964, (Published online on Feb. 14, 2012).
Jiang W., et al., "CRISPR-Cas: New Tools for Genetic Manipulations of Bacterial Immunity Systems," Annual Review of Microbiology, vol. 69, No. 1, Jul. 22, 2015, pp. 209-228.
Jiang W., et al., "Demonstration of CRISPR/Cas9/sgRNA-Mediated Targeted Gene Modification in *Arabidopsis*, Tobacco, Sorghum and Rice," Nucleic Acids Research, Published Online Sep. 2, 2013, Nov. 1, 2013, vol. 41, No. 20, 12 pages, Oxford University Press, GB, doi:10.1093/nar/gkt780, ISSN 0305-1048, XP055219328.
Jiang W., et al., "Efficient CRISPR/Case9-Mediated Gene Editing in *Arabidopsis thaliana* and Inheritance of Modified Genes in the T2 and T3 Generations," PLoS One, Jun. 11, 2014, vol. 9, No. 6(e99225), pp. 1-10.
Jiang W., et al., "RNA-Guided Editing of Bacterial Genomes using CRISPR-Cas Systems," Nature Biotechnology, Mar. 2013, vol. 31, No. 3, pp. 233-239, Online Methods, 2 Pages, Supplementary Materials, 21 pages, 30 Total Pages, DOI:10.1038/nbt.2508, ISSN 0003537408, XP002699849.
Jiang W., et al., "Successful Transient Expression of Cas9 and Single Guide RNA Genes in Chlamydomonas Reinhardtii," Eukaryotic Cell, Epub Sep. 19, 2014, Nov. 2014, vol. 13, No. 11, pp. 1465-1469, 22 pages.
Jinek M., et al., "A Programmable Dual-RNA-Guided DNA Endonuclease in Adaptive Bacterial Immunity," Science, Aug. 17, 2012, vol. 337, pp. 816-821, E-Published on Jun. 28, 2012, (6 Pages), Supplementary Materials and Methods (37 Pages). (43 total Pages), DOI:10.1126/science.1225829, ISSN 00368075, XP055067747 and XP055067740.
Jinek M., et al., "RNA-Programmed Genome Editing in Human Cells," Elife, Jan. 29, 2013, vol. 2:e00471, pp. 1-9.
Johnson R.A., et al., "A Rapid Assay to Quantify the Cleavage Efficiency of Custom-Designed Nucleases in Planta," Plant Molecular Biology, 2013, vol. 82, pp. 207-221.
Jore M.M., et al., "Structural Basis for CRISPR RNA-guided DNA Recognition by Cascade," Nature Structural Molecular Biology, May 2011, vol. 18, No. 5, pp. 529-537 (and Supplemental).
Jung J.H., et al., "Challenges in Wide Implementation of Genome Editing for Crop Improvement," Journal of Crop Science and Biotechnology, 2017, vol. 20, No. 2, pp. 129-135.
Kallimasioti-Pazi E.M., et al., "Heterochromatin Delays CRISPR-Cas9 Mutagenesis but does not Influence the Outcome of Mutagenic DNA Repair," PLoS Biology, Accepted: Nov. 21, 2018, Published: Dec. 12, 2018, vol. 16, No. 12, e2005595, 22 pages.
Kanchiswamy C.N., et al., "Non-GMO Genetically Edited Crop Plants," Trends in Biotechnology, Sep. 2015, vol. 33, No. 9, pp. 489-491, DOI: 10.1016/J.TIBTECH.2015.04.002, XP002765281.
Kartje, et al., "Chimeric Guides Probe and Enhance Cas9 Biochemical Activity," Biochemistry, 2018, vol. 57, No. 21, pp. 3027-3031.
Karvelis T., et al., "PAM Recognition by Miniature CRISPR-Cas14 Triggers Programmable Double-Stranded DNA Cleavage," bioRxiv, May 30, 2019, 10 Pages, DOI: http://dx.doi.org./10.101/654897.
Karvelis T., et al., "Rapid Characterization of CRISPR-Cas9 Protospacer Adjacent Motif Sequence Elements," Genome Biology, Nov. 19, 2015, vol. 16, No. 253, 13 Pages, DOI:10.1186/s13059-015-0818-7, XP055293242.
Keeler S.J., et al., "Regulation of Tobacco Acetolactate Synthase Gene Expression," Plant Physiology, Rockville, Md, USA, Jul. 1, 1993, vol. 102, No. 3, pp. 1009, 1018, DOI:10.1104/pp.102.3.1009, ISSN 00320889, XP055978016.
Kilby N.J., et al., "FLP Recombinase in Transgenic Plants: Constitutive Activity in Stably Transformed Tobacco and Generation of Marked Cell Clones in *Arabidopsis*," The Plant Journal, Nov. 1995, vol. 8, No. 5, pp. 637-652.
Kim G.B., et al., "Isolation and Characterization of Medicago Truncatula U6 Promoters for the Construction of Small Hairpin RNA-Mediated Gene Silencing Vectors," Plant Molecular Biology Reporter, Jun. 2014, 2013, vol. 31, No. 3, pp. 581-593.
Kim H., et al., "CRISPR/Cpf1-Mediated DNA-Free Plant Genome Editing," Nature Communications, Published Feb. 16, 2017, vol. 8, No. 14406, DOI: 10.1038/ncomms14406.
Kim H., et al., "Targeted Genome Editing for Crop Improvement," Plant Breeding And Biotechnology, Dec. 30, 2015, vol. 3, No. 4, pp. 283-290, (Published on Nov. 30, 2015).
Kim H.Y., et al., "Chimeric crRNAs with 19 DNA Residues in the Guide Region Show the Retained DNA Cleavage Activity of Cas9 with Potential to Improve the Specificity," Chemical Communications, Feb. 28, 2019, vol. 55, pp. 3552-3555.
Kim S., et al., "Highly Efficient RNA-Guided Genome Editing in Human Cells Via Delivery of Purified Cas9 Ribonucleoproteins," Genome Research, Apr. 2, 2014, vol. 24, pp. 1012-1019.
Kindle K.L., et al., "High-frequency Nuclear Transformation of Chlamydomonas Reinhardtii," Proceedings of the National Academy of Sciences of the United States of America, Feb. 1990, vol. 87, pp. 1228-1232.
Klee H., et al., "Agrobacterium-Mediated Plant Transformation and Its Further Applications to Plant Biology," Annual Review of Plant Physiology, 1987, vol. 38, pp. 467-486.
Klein T.M., et al., "High-Velocity Microprojectiles for Delivering Nucleic Acids into Living Cells," Nature, May 7, 1987, vol. 327, pp. 70-73.
Kocak D.D., et al., "Increasing the Specificity of CRISPR Systems with Engineered RNA Secondary Structures," Nature Biotechnology, Jun. 2019, vol. 37, pp. 657-666.
Kohli A., et al., "Transgene Organization in Rice Engineered Through Direct DNA Transfer Supports a Two-Phase Integration Mechanism Mediated by the Establishment of Integration Hot Spots," The Proceedings of the National Academy of Sciences, 1998, vol. 95, pp. 7203-7208.
Koo T., et al., "Measuring and Reducing Off-Target Activities of Programmable Nucleases Including CRISPR-Cas9," Molecules and Cells, 2015, vol. 38, No. 6, pp. 475-481.
Koonin E.V., et al., "CRISPR-CAS Evolution of an RNA-Based Adaptive Immunity System in Prokaryotes," RNA Biology, May 2013, vol. 10, No. 5, pp. 679-686.
Koonin E.V., et al., "Diversity, Classification and Evolution of CRISPR-Cas Systems," Current Opinion in Microbiology, 2017, vol. 37, pp. 67-78.
Kregten, et al., "Agrobacterium-Mediated T-DNA Transfer and Integration by Minimal VirD2 Consisting of the Relaxase Domain and a Type IV Secretion System Translocation Signal," Molecular Plant-Microbe Interactions, 2009, vol. 22, No. 11, pp. 1356-1365.

(56) References Cited

OTHER PUBLICATIONS

Kumar V., et al., "The CRISPR_Cas System for Plant Genome Editing: Advances and Opportunities," Journal of Experimental Botany, 2015, vol. 66, No. 1, pp. 47-57, Advance Access Publication Nov. 4, 2014.

Kuscu C., et al., "Genome-Wide Analysis Reveals Characteristics of Off-Target Sites Bound by the Cas9 Endonuclease," Nature Biotechnology, Jul. 2014, vol. 32, No. 7, pp. 677-683, (Published Online on May 18, 2014).

Leblanc C., et al., "Increased Efficiency of Targeted Mutagenesis by CRISPR/Cas9 in Plants Using Heat Stress," The Plant Journal, 2018, vol. 93, pp. 377-386, (Published online on Nov. 21, 2017).

Lee C.M., et al., "Nuclease Target Site Selection for Maximizing on-Target Activity and Minimizing Off-Target Effects in Genome Editing," Molecular Therapy: The Journal of the American Society of Gene Therapy, Mar. 1, 2016, vol. 24, No. 3, pp. 475-487.

Leenay R.T., et al., "Identifying and Visualizing Functional PAM Diversity across CRISPR-Cas Systems," Molecular Cell, Cell Press, Cambridge, MA, US, Apr. 7, 2016, vol. 62, No. 1, pp. 137-147 and Supplemental, Epublished on Mar. 31, 2016.

Leonard M.T., et al., "Complete Genome Sequences of Lactobacillus Johnsonii Strain N6.2 and Lactobacillus Reuteri Strain TD1," Genome Announcements, May 8, 2014, vol. 2, No. 3(e00397-14), 2 Pages, DOI:10.1128/genomeA.00397-14, XP055292032.

Li H., et al., "In Vivo Genome Editing Restores Haemostasis in a Mouse Model of Haemophilia," Nature, Jul. 14, 2011, vol. 475, No. 7355, pp. 217-221, 07 Pages.

Li J.F., et al., "Multiplex and Homologous Recombination-Mediated Genome Editing in *Arabidopsis* and Nicotiana Benthamiana Using Guide RNA and Cas9," Nature Biotechnology, Aug. 2013, vol. 31, No. 8, pp. 688-691.

Li J-F., et al., "Multiplex and Homologous Recombination-Mediated Plant Genome Editing in *Arabidopsis* and Nicotiana Benthamiana using Guide RNA and Cas9," Nature Biotechnology, Aug. 2013, vol. 31, No. 8 (Supplemental), pp. 688-691, 15 Pages.

Li L., et al., "An Improved Rice Transformation System Using the Biolistic Method," Plant Cell Reports, 1993, vol. 12, pp. 250-255, doi:doi:10.1007/BF00237129, XP002955271.

Li S., et al., "Synthesis-Dependent Repair of Cpf1-Induced Double Strand DNA Breaks Enables Targeted Gene Replacement in Rice," Journal of Experimental Botany, Jun. 28, 2018, vol. 69, No. 20, pp. 4715-4721.

Li T., et al., "High-Efficiency TALEN-Based Gene Editing Produces Disease-Resistant Rice," Nature Biotechnology, May 7, 2012, vol. 30, No. 5, pp. 390-392, 25 Pages, Supplementary Information.

Li X., et al., "Varied Transcriptional Efficiencies of Multiple *Arabidopsis* U6 Small Nuclear RNA Genes," Journal of Integrative Plant Biology, 2007, vol. 49, No. 2, pp. 222-229.

Li X-Q., "Comparative Analysis of the Base Compositions of the Pre-mRNA 3' Cleaved-Off Region and the mRNA 3' Untranslated Region Relative to the Genomic Base Composition in Animals and Plants," PLoS One, Jun. 18, 2014, vol. 9, Issue 6, e99928, 12 pages.

Li Z., et al., "Cas9-Guide RNA Directed Genome Editing in Soybean," Plant Physiology, Aug. 20, 2015, Oct. 2015, vol. 169, No. 2, pp. 960-970.

Li Z., et al., "Site-Specific Integration of Transgenes in Soybean via Recombinase-Mediated DNA Cassette Exchange," Plant Physiology, Nov. 1, 2009, vol. 151, No. 3, pp. 1087-1095.

Liang X., et al., "Rapid and Highly Efficient Mammalian Cell Engineering via Cas9 Protein Transfection," Journal of Biotechnology, May 21, 2015, vol. 208, pp. 44-53.

Liang Z., et al., "Efficient DNA-free Genome Editing of Bread Wheat Using CRISPR/Cas9 Ribonucleoprotein Complexes," Nature Communications, Jan. 18, 2017, vol. 8, No. 14261, 5 Pages.

Liang Z., et al., "Targeted Mutagenesis in Zea mays using TALENs and the CRISPR/Cas System," Journal of Genetics and Genomics, Elsevier, BV, NL, 2014, vol. 41, No. 2, pp. 63-68, (Published Online on Dec. 14, 2013), Doi: 10.1016/J.JGG.2013.12.001, ISSN 1673-8527, XP028661345.

Lieber M.R., et al., "The Mechanism of Double-Strand DNA Break Repair by the Nonhomologous DNA End Joining Pathway," Annual Review of Biochemistry, 2010, vol. 79, pp. 181-211, 34 Pages.

Lin S., et al., "Enhanced Homology-directed Human Genome Engineering by Controlled Timing of CRISPR/Cas9 Delivery," ELife, Dec. 15, 2014, vol. 3, e04766, 32 pages.

Liu J., et al., "Nucleic Acid Molecules and Other Molecules Associated with Plants and Uses Thereof for Plant Improvement," US20040034888, Seq ID No. 17986, Sequence Alignment with Seq ID No. 9, Feb. 19, 2004, 1 Page.

Liu J-J., et al., "CasX Enzymes Comprise a Distinct Family of RNA-guided Genome Editors," Nature, Feb. 14, 2019, vol. 566, pp. 218-240 (Incl. Supplementary Material).

Lloyd A.M., et al., "Functional Expression of the Yeast FLP/FRT Site-Specific Recombination System in Nicotiana Tabacum," Molecular and General Genetics, Mar. 1994, vol. 242, No. 6, pp. 653-657.

Stemmer M., et al., "CCTop: An Intuitive, Flexible and Reliable CRISPR/Cas9 Target Prediction Tool," PLoS One, Apr. 24, 2015, vol. 10, No. 4, e0124633, 11 Pages.

Strauss A., et al., "Zinc Fingers, TAL Effectors, or Cas9-Based DNA Binding Proteins: What's Best for Targeting Desired Genome Loci?," Molecular Plant, Sep. 2013, vol. 6, No. 5, pp. 1384-1387.

Stryer L., et al., "A Nucleic Acid Consists of Four Kinds of Bases Linked to a SugarPhosphate Backbone", Stryer's Biochemistry, Sixth Edition, 2002, pp. 108-109, XP055688354.

Subburaj S., et al., "Site-Directed Mutagenesis in Petunia × Hybrida Protoplast System Using Direct Delivery of Purified Recombinant Cas9 Ribonucleoproteins," Plant Cell Reports, 2016, vol. 35, pp. 1535-1544.

Sugita K., et al., "A Transformation Vector for the Production of Marker-free Transgenic Plants Containing a Single Copy Transgene at High Frequency," The Plant Journal, Jun. 2000, vol. 22, No. 5, pp. 461-469.

Sun Z., et al., "Expanding the Biotechnology Potential of Lactobacilli Through Comparative Genomics of 213 Strains and Associated Genera," Nature Communications, Nature Publishing Group, UK, Sep. 29, 2015, vol. 6, Article No. 8322, 13 Pages.

Svitashev S., et al., "Genome Editing in Maize Directed by CRISPR-Cas9 Ribonucleoprotein Complexes," Nature Communications, Nov. 16, 2016, vol. 07, Article No. 13274, 7 Pages, DOI: 10.1038/ncomms13274, PMID: 27848933, PMCID: PMC5116081.

Svitashev S., et al., "Targeted Mutagenesis, Precise Gene Editing, and Site-Specific Gene Insertion in Maize using Cas9 and Guide RNA," Plant Physiology, 2015, vol. 169, No. 2, pp. 931-945.

Tan S., et al., "Imidazolinone-Tolerant Crops: History, Current Status and Future," Pest Management Science, Wiley Sons, Bognor Regis; GB, Jan. 1, 2005, vol. 61, No. 03, pp. 246-257, DOI:10.1002/ps.993, ISSN 1526-498X, XP009058795.

Tang X., et al.: "A CRISPR-Cpf1 System for Efficient Genome Editing and Transcriptional Repression in Plants," Nature Plants, 2017, vol. 3, Article No. 17018, 16 Pages.

Tinland B., et al., "The T-DNA-Linked VirD2 Protein Contains Two Distinct Functional Nuclear Localization Signals," Proceedings of the National Academy of Sciences of the United States of America, Aug. 1992, vol. 89, pp. 7442-7446.

Ui-Tei K., et al., "Functional Dissection of siRNA Sequence by Systematic DNA Substitution: Modified siRNA with a DNA Seed Arm is a Powerful Tool for Mammalian Gene Silencing with Significantly Reduced Off-Target Effect," Nucleic Acids Research, 2008, vol. 36, No. 7, pp. 2146-2151.

UniProt: RecName: "Full-CRISPR-Associated Endonuclease Cas9," Database Accession No. A0A0F4LLE0, 2015, 2 Pages, Retrieved from URL: EBI.

UniProt: RecName: "Full-CRISPR-Associated Endonuclease Cas9," Database Accession No. H0UDA8, 2012, Retrieved from URL: EBI.

Unniyampurath U., et al., "RNA Interference in the Age of CRISPR: Will CRISPR Interfere with RNAi," International Journal of Molecular Sciences, Feb. 26, 2016, vol. 17, No. 291, 15 Pages.

Voytas D.F., "Plant Genome Engineering with Sequence-Specific Nucleases," Annual Review of Plant Biology ,Mar. 1, 2013, vol. 64, pp. 327-350.

(56) References Cited

OTHER PUBLICATIONS

Wang H., et al., "One-Step Generation of Mice Carrying Mutations in Multiple Genes by CRISPR/Cas-Mediated Genome Engineering," Cell, May 9, 2013, vol. 153, No. 4, pp. 910-918, 17 Pages.

Wang J., et al., "Targeted Gene Addition to a Predetermined Site in the Human Genome Using a ZFN-based Nicking Enzyme," Genome Research, 2012, vol. 22, pp. 1316-1326.

Wang M., et al., "Multiplex Gene Editing in Rice Using the CRISPR-Cpf1 System," Molecular Plant, 2017, vol. 10, No. 7, pp. 1-3.

Wang M-B., et al., "Hairpin RNAs Derived from RNA Polymerase II and Polymerase III Promoter-Directed Transgenes are Processed Differently in Plants," RNA, May 2008, vol. 14, No. 5, pp. 903-913, DOI: 10.1261/RNA.760908, ISSN 1355-8382, XP002639663.

Wang Y., et al., "Genes Controlling Plant Architecture," Current Opinion in Biotechnology, Apr. 2006, vol. 17, No. 2, pp. 123-129, ISSN 0958-1669, XP024962866.

Wei F., et al., "Physical and Genetic Structure of the Maize Genome Reflects Its Complex Evolutionary History," PLoS Genetics, Jul. 20, 2007, vol. 3, No. 7, pp. 1254-1263.

Wendt T., et al., "TAL Effector Nucleases Induce Mutations at a Pre-Selected Location in the Genome of Primary Barley Transformants," Plant Molecular Biology, 2013, vol. 83, pp. 279-285, Retrieved from URL: https://doi.org/10.1007/s11103-013-0078-4.

Westra E.R., et al., "CRISPR Immunity Relies on the Consecutive Binding and Degradation of Negatively Supercoiled Invader DNA by Cascade and Cas3," Molecular Cell, Jun. 8, 2012, vol. 46, No. 5, pp. 595-605, E-Published on Apr. 19, 2012.

Wiedenheft B., et al., "RNA-Guided Genetic Silencing Systems in Bacteria and Archaea," Nature, Feb. 16, 2012, vol. 482, pp. 331-338.

Wierzbicki A.T., et al., "Noncoding Transcription by RNA Polymerase Pol IVb/Pol V Mediates Transcriptional Silencing of Overlapping and Adjacent Genes," Cell, Nov. 14, 2008, vol. 135, pp. 635-648.

Wolter F., et al., "Knocking Out Consumer Concerns and Regulators Rules: Efficient Use of CRISPR/Cas Ribonucleoproteir Complexes for Genome Editing in Cereals," Genome Biology, 2017, vol. 18, No. 43, 3 Pages.

Woo J.W., et al., "DNA-Free Genome Editing in Plants with Preassembled CRISPR-Cas9 Ribonucleoproteins," Nature Biotechnology, US, Oct. 19, 2015, vol. 33, No. 11, pp. 1162-1164, DOI:10.1038/nbt.3389, ISSN 1087-0156, XP055290196.

Wu J., et al., "Tn5 Transposase-Assisted Transformation of Indica Rice," The Plant Journal, Oct. 2011, vol. 68, pp. 186-200.

Xiang G., et al., "Temperature Effect on CRISPR-Cas9 Mediated Genome Editing," Journal of Genetics Genomics, 2017, vol. 44, pp. 199-205.

Xiaoqing Y., et al., "Constitutive Expression of Human Coagulating Factor IX in HeLa Cells by Homologous Recombination of the Promoter," Science in China (Series C), Life Science, Feb. 2001, vol. 44, No. 1, pp. 18-24.

Xie K., et al., "Boosting CRISPR/Cas9 Multiplex Editing Capability with the Endogenous tRNA-Processing System," PNAS, Mar. 17, 2015, vol. 112, No. 11, pp. 3570-3575.

Xie K., et al., "RNA-Guided Genome Editing in Plants Using a CRISPR-Cas System," Molecular Plant, Nov. 2013, vol. 6, No. 6, pp. 1975-1983.

Xing H-L., e al., "A CRISPR/Cas9 Toolkit for Multiplex Genome Editing in Plants," BMC Plant Biology, 2014, vol. 14, No. 1, pp. 327-338, 12 Pages.

Xu K., et al., "Efficient Genome Engineering in Eukaryotes Using Cas9 from *Streptococcus thermophilus*," Cellular and Molecular Life Sciences, 2015, vol. 72, pp. 383-399, 40 Pages.

Xu L., et al., "Empower Multiplex Cell and Tissue-Specific CRISPR-Mediated Gene Manipulation with Self-Cleaving Ribozymes and tRNA," Nucleic Acids Research, 2016, vol. 45, No. 5(e28), 9 Pages.

Xu R., et al., "Gene Targeting Using the Agrobacterium Tumefaciens-Mediated CRISPR-Cas System in Rice," Rice, May 2014, vol. 7, No. 1, pp. 1-4.

Xue C., et al., "CRISPR Interference and Priming Varies with Individual Spacer Sequences," Nucleic Acids Research, 2015, vol. 43, No. 22, pp. 10831-10847, Published Online Nov. 19, 2015.

Xueyuan L., et al., "Efficient Protoplast Regeneration Protocol and CRISPR/Cas9-Mediated Editing of Glucosinolate Transporter (GTR) Genes in Rapeseed (*Brassica napus* L.)," Frontiers in Plant Science, Jul. 7, 2021, vol. 12, Article. 680859.

Yan W.X., et al., "Functionally Diverse Type V CRISPR-Cas Systems," Science, Jan. 4, 2019, vol. 363, pp. 88-91, 5 Pages.

Yao X., et al., "Homology-Mediated End Joining-Based Targeted Integration Using CRISPR/Cas9," Cell Research, Jun. 2017, vol. 27, No. 6, pp. 801-814.

Yin H., et al., "Partial DNA-Guided Cas9 Enables Genome Editing with Reduced Off-Target Activity," Nature Chemical Biology, Mar. 2018, vol. 14, pp. 311-317, 10 Pages, (And Life Sciences Reporting Summary).

Yin X., et al., "CRISPR-Cas9 and CRISPR-Cpf1 Mediated Targeting of a Stomatal Developmental Gene EPFL9 in Rice," Plant Cell Reports, 2017, vol. 36, pp. 745-757.

Yu Q., et al., "Resistance to AHAS Inhibitor Herbicides: Current Understanding," Pest Management Science, Sep. 1, 2014, vol. 70, No. 9, pp. 1340 1350, DOI:10.1002/ps.3710, ISSN 1526498X, XP055978019.

Zetsche B., et al., "Cpf1 is a Single RNA-Guided Endonuclease of a Class 2 CRISPR-Cas System," Cell, Oct. 22, 2015, vol. 163, No. 3, pp. 759-771, 14 Pages, Oct. 1, 2015.

Zhang F., et al., "High Frequency Targeted Mutagenesis in *Arabidopsis thaliana* Using Zinc Finger Nucleases," Proceedings of the National Academy of Sciences of the United States of America, Jun. 29, 2010, vol. 107, No. 26, pp. 12028-12033, Retrieved from URL: https://doi.org/10.1073/pnas.0914991107.

Zhang H., et al., "The CRISPR/Cas9 System Produces Specific and Homozygous Targeted Gene Editing in Rice in One Generation," Plant Biotechnology Journal, 2014, vol. 12, No. 6, pp. 797-807.

Zhang J-P., et al., "Efficient Precise Knockin with a Double Cut HDR Donor After CRISPR/Cas9-Mediated Double-Stranded DNA Cleavage," Genome Biology, 2017, vol. 18, No. 35, pp. 1-18.

Zhang Y., et al., "A Highly Efficient Rice Green Tissue Protoplast System for Transient Gene Expression and Studying Light/Chloroplast-Related Processes," Plant Methods, Sep. 30, 2011, vol. 7, No. 1, Article No. 30, 14 Pages.

Zhang Y., et al., "Transcription Activator-Like Effector Nucleases Enable Efficient Plant Genome Engineering1[W][OA]," Plant Physiology, Nov. 2, 2012, vol. 161, No. 1, pp. 20-27, DOI:10.1104/pp.112.205179, ISSN 0032-0889, XP055070911.

Abler M.L., et al., "Control of mRNA Stability in Higher Plants," Plant Molecular Biology, 1996, vol. 32, pp. 63-78.

Ainley W.M., et al., "Trait Stacking via Targeted Genome Editing," Plant Biotechnology Journal, Aug. 19, 2013, vol. 11, No. 9, pp. 1126-1134, DOI:10.1111/pbi.12107, ISSN 1467-7644, XP055218224.

Ali Z., et al., "Efficient Virus-Mediated Genome Editing in Plants using the CRISPR/Cas9 system," Molecular Plant, Aug. 2015, vol. 8, pp. 1288-1291.

Anders C., et al., "Structural Basis of PAM-Dependent Target DNA Recognition by the Cas9 Endonuclease," Nature, Sep. 25, 2014, vol. 513, pp. 569-573.

Anonymous, "CRISPR-Cas9 Genome Engineering with Dharmacon Tm Edit-RTM Inducible Lentiviral Cas9 Nuclease," Horizon technical manual, Apr. 2014, pp. 1-18, XP055967783.

Anonymous: "Hypothetical Protein [Lactobacillus reuteri]: NCBI Reference Sequence: WP_019251774.1," NCBI Protein, Jun. 29, 2013, 1 Page, XP055291687, [Retrieved on Jul. 27, 2016] Retrieved from URL: http://www.ncbi.nlm.nih.gov/protein/518081566?sat=21&satkey=43236412.

Anonymous: "Lactobacillus Reuteri TD1, Complete Genome, NCBI Reference Sequence: NC_021872.1," NCBI Nucleotide, Feb. 8, 2015, 592 Pages, XP055291935, [Retrieved on Jul. 28, 2016] Retrieved from URL: http://www.ncbi.nlm.nih.gov/nuccore/526230725?report=gb&sat=21satkey=30378633.

Application Forum: "A Streamlined Method for the Production, Screening, and Application of sgRNAs for CRISPR/Cas9 Gene Editing," Sponsored Paper, BioTechniques, 2014, vol. 57, No. 3, p. 157.

(56) References Cited

OTHER PUBLICATIONS

Avila-Garcia W.V., et al., "Target site Mutation Associated with Glufosinate resistance in Italian Ryegrass (*Lolium perenne* L. ssp. *multiflorum*)," Pest Management Science, Sep. 1, 2012, vol. 68, No. 9, pp. 1248-1254, DOI:10.1002/ps.3286, ISSN 1526498X, XP055978022.

Bae S., et al., "Cas-OFFinder: A Fast and Versatile Algorithm that Searches for Potential Off-Target sites of Cas9 RNA-Guided Endonucleases," Bioinformatics, 2014, vol. 30, No. 10, pp. 1473-1475.

Baltes N.J., et al., "DNA Replicons for Plant Genome Engineering," The Plant Cell, Jan. 2014, vol. 26, No. 1, pp. 151-163.

Barrangou R., et al., "CRISPR Provides Acquired Resistance Against Viruses in Prokaryotes," Science, Mar. 23, 2007, vol. 315, pp. 1709-1712.

Barrangou R., et al., "CRISPR-Cas Systems and RNA-guided Interference," WIREs RNA, May/Jun. 2013, vol. 4, pp. 267-278.

Barrangou R., et al., "CRISPR-Cas Systems: Prokaryotes Upgrade to Adaptive Immunity," Molecular Cell, Apr. 24, 2014, vol. 54, pp. 234-244.

Barrangou R., "RNA-Mediated Programmable DNA Cleavage," Nature Biotechnology, Sep. 2012, vol. 30, No. 9, pp. 836-838.

Barrett C.M., et al., "Unlocking Access to DNA in Chromatin," Chemical Engineering Progress, Sep. 2018, vol. 114, No. 9, pp. 55-62.

Bassett A.R., et al., "Highly Efficient Targeted Mutagenesis of Drosophila with the CRISPR/Cas9 system," Cell Reports, Jul. 11, 2013, vol. 4, No. 1, pp. 220-228, EPublished on Jul. 1, 2013.

Beetham P.R., et al., "A Tool for Functional Plant Genomics: Chimeric RNA/DNA Oligonucleotides Cause in Vivo Gene-Specific Mutations," Proceedings of the National Academy of Sciences, USA, Plant Biology, Jul. 1999, vol. 96, pp. 8774-8778.

Begemann M.B., et al., "Precise Insertion and Guided Editing of Higher Plant Genomes using Cpf1 CRISPR Nucleases," BioRxiv, 2017, 16 Pages, DOI: http://dx.doi.org/10.1101/109983.

Belhaj K., et al. "Plant Genome Editing Made Easy: Targeted Mutagenesis in Model and Crop Plants Using the CRISPR/Cas System," Plant Methods, Oct. 2013, vol. 9, pp. 1-10.

Beurdeley M., et al., "Compact Designer TALENs for Efficient Genome Engineering," Nature Communications, Apr. 23, 2013, vol. 4, No. 1762, pp. 1-8.

Bollen Y., et al: "How to Create State-of-The-Art Genetic Model Systems: Strategies for Optimal CRISPR-Mediated Genome Editing," Nucleic Acids Research, 2018, vol. 46, No., 13, pp. 6435-6454.

Bolotin A., et al., "Clustered Regularly Interspaced Short Palindrome Repeats (CRISPRs) have Spacers of Extrachromosomal Origin," Microbiology, Accepted on May 30, 2005, vol. 151, pp. 2551-2561.

Bolotin A., et al., "Complete Sequence and Comparative Genome Analysis of the Dairy Bacterium *Streptococcus thermophilus*," Nature Biotechnology, Dec. 2004, vol. 22, No. 12, pp. 1554-1558, 6 Pages.

Bondy-Denomy J., et al., "To Acquire or Resist: the Complex Biological Effects of CRISPR-Cas Systems," Trends in Microbiology, Epub Feb. 26, 2014, Apr. 2014, vol. 22, No. 4, pp. 218-225.

Bortesi L., et al., "The CRISPR/Cas9 System for Plant Genome Editing and Beyond," Biotechnology Advances, Jan. 1, 2015, vol. 33, No. 1, pp. 41-52, XP055217852.

Brief for Appellees for Appeal No. 2017-1907 submitted to the United States Court of Appeals for the Federal Circuit on Oct. 25, 2017, 80 pages.

Briner A.E., et al., "Guide RNA Functional Modules Direct Cas9 Activity and Orthogonality," Molecular Cell, Oct. 23, 2014, vol. 56, No. 2, 16, pp. 333-339, 17 Pages, Supplemental Information.

Briner A.E., et al., "Guide RNA Functional Modules Direct Cas9 Activity and Orthogonality," Molecular Cell, Oct. 23, 2014, vol. 56, No. 2, pp. 333-339.

Burstein D., et al., "New CRISPR-Cas Systems from Uncultivated Microbes," Nature, Feb. 9, 2017, vol. 542, pp. 237-241 (plus supplementary material).

Byrum J.R., et al., "N_Geneseq Database," Accession No. ARD65600, US 20070083945, Apr. 12, 2007, Seq ID No. 147296.

Cai Y., et al., "Optimizing the Codon Usage of Synthetic Gene with QPSO Algorithm," Journal of Theoretical Biology, Sep. 7, 2008, vol. 254, No. 1, pp. 123-127, EPublished on May 17, 2008.

Carte J., et al., "Cas6 is an Endoribonuclease that Generates Guide RNAs for Invader Defense in Prokaryotes," Genes and Development, 2008, vol. 22, pp. 3489-3496.

Cenik E.S., et al., "Argonaute Proteins," Current Biology, 2011, vol. 21, No. 12, pp. R446-449.

Cermak T., et al., "A Multipurpose Toolkit to Enable Advanced Genome Engineering in Plants," The Plant Cell, Jun. 2017, vol. 29, pp. 1196-1217.

Chai R., et al., "B-Glucan Synthase Gene Overexpression and β-glucans Overproduction in Pleurotus Ostreatus Using Poromoter Swapping," PLoS One, Apr. 24, 2013, vol. 8, Issue 4, e61693.

Chang N., et al., "Genome Editing with RNA-guided Cas9 Nuclease in Zebrafish Embryos," Cell Research, Apr. 2013, vol. 23, pp. 465-472.

Chang Y-J., et al., "Complete Genome Sequence of Acidaminococcus Fermentans Type Strain (VR4T)," Standards in Genomic Sciences, 2010, vol. 3, pp. 1-14.

Chen H., et al., "Promise and Issues of Genetically Modified Crops," Current Opinion in Plant Biology, May 1, 2013, vol. 16, No. 2, pp. 255-260, DOI:10.1016/j.pbi.2013.03.007, ISSN 1369-5266, XP055070912.

Chen J.S., et al., "CRISPR-Cas12a Target Binding Unleashes Indiscriminate Single-Stranded DNase Activity," Science, Apr. 27, 2018, vol. 360, pp. 436-439.

Chen S., et al., "Highly Efficient Mouse Genome Editing by CRISPR Ribonucleoprotein Electroporation of Zygotes," The Journal of Biological Chemistry, US, Jul. 8, 2016, vol. 291, No. 28, pp. 14457-14467, DOI:10.1074/jbc.M116.733154, ISSN 0021-9258, XP055363781.

Cheng A.W., et al., "Multiplexed Activation of Endogenous Genes by CRISPR-on, an RNA-Guided Transcriptional Activator System," Cell Research, Oct. 2013, vol. 23, No. 10, pp. 1163-1171.

Cho S.W., et al., "Analysis of Off-Target Effects of CRISPR/Cas-Derived RNA-Guided Endonucleases and Nickases," Genome Research, 2014, vol. 24, pp. 132-141.

Cho S.W., et al., "Targeted Genome Engineering in Human Cells with the Cas9 RNA-Guided Endonuclease," Nature Biotechnology, Mar. 2013, vol. 31, No. 3, pp. 230-232, 3 Pages, Supplementary Information (11 Pages).

Christou P., et al., "Stable Transformation of Soybean Callus by DNA-Coated Gold Particles," Plant Physiology, 1988, vol. 87, pp. 671-674.

Chylinski K., et al., "Classification and Evolution of Type II CRISPR-Cas Systems," Nucleic Acids Research, Published on Apr. 11, 2014, vol. 42, No. 10, pp. 6091-6105.

Chylinski K., et al., "The TracrRNA and Cas9 Families of Type II CRISPR-Cas Immunity Systems," RNA Biology, May 2013, vol. 10, No. 10, pp. 726-737.

Claesson M.J., et al., "Multireplicon Genome Architecture of Lactobacillus Salivarius," Proceedings of the National Academy of Sciences, Apr. 25, 2006, vol. 103 No. 17, pp. 6718-6723.

Communication of a Notice of European Opposition Opponents Submissions for European Application No. 14761478.8, Ref No. 417331 EPAXB/CX, dated Oct. 24, 2022, 31 Pages.

Cong, et al., "Multiplex Genome Engineering Using CRISPR/Cas Systems," Science, 2013, vol. 339, Supplementary Material, 37 Total Pages.

Belhaj K., et al., "Plant Genome Editing Made Easy: Targeted Mutagenesis in Model and Crop Plants Using the CRISPR/Cas System," Plant Methods, 2013, vol. 9, No. 1, pp. 39-48.

Tan S., et al., "Imidazolinone-Tolerant Crops: History, Current Status and Future," Pest Management Science, Wiley & Sons, Bognor Regis; GB, Jan. 1, 2005, vol. 61, No. 03, pp. 246-257, DOI:10.1002/ps.993, ISSN 1526-498X, XP009058795.

(56) References Cited

OTHER PUBLICATIONS

Che P., et al., "Wuschel2 Enables Highly Efficient CRISPR/Cas-Targeted Genome Editing During Rapid De Novo Shoot Regeneration in Sorghum," Communications in Biology, 2022, vol. 5, pp. 1-11.
Songstad D.D. et al., "Production of Transgenic Maize Plants and Progeny by Bombardment of Hi-II Immature Embryos," In Vitro Cellular & Developmental Biology-plant, 1996, vol. 32, pp. 179-183.
Morrell P., et al., "Crop Genomics: Advances and Applications" Nature Reviews Genetics, 2011, vol. 13 (2), pp. 85-96.
Cole-Strauss A., et al., "Targeted Gene Repair Directed by the Chimeric RNA/DNA Oligonucleotide in a Mammalian Cell-free Extract," Nucleic Acids Research, vol. 27, No. 5, Mar. 1, 1999, pp. 1323-1330.
Upadhyay S.M., et al., "RNA-guided Genome Editing for Target Gene Mutations in Wheat," G3 (Bethesda, Md.), Dec. 9, 2013, vol. 3, No. 12, pp. 2233-2238.
Zhu T., et al., "Targeted Manipulation of Maize Genes in Vivo Using Chimeric RNA/DNA Oligonucleotides," Proceedings of the National Academy of Sciences, Jul. 20, 1999, vol. 96, No. 15 pp. 8768-8773.

\* cited by examiner

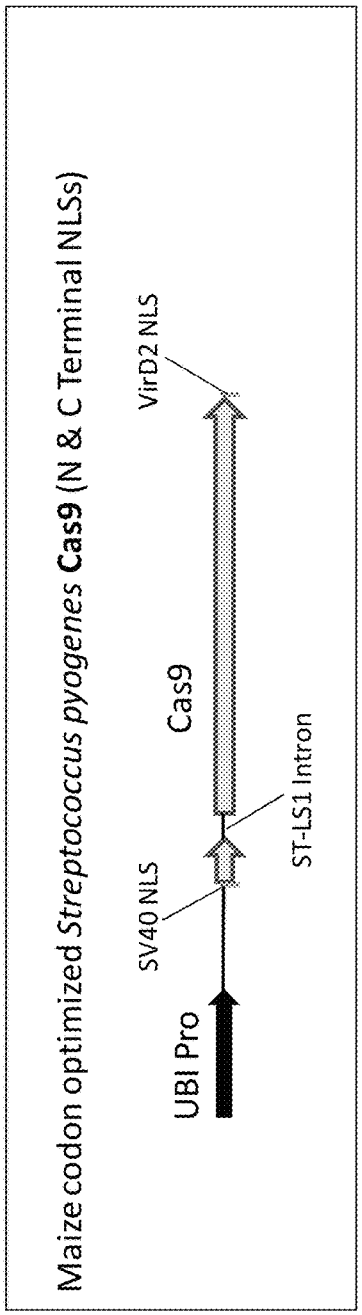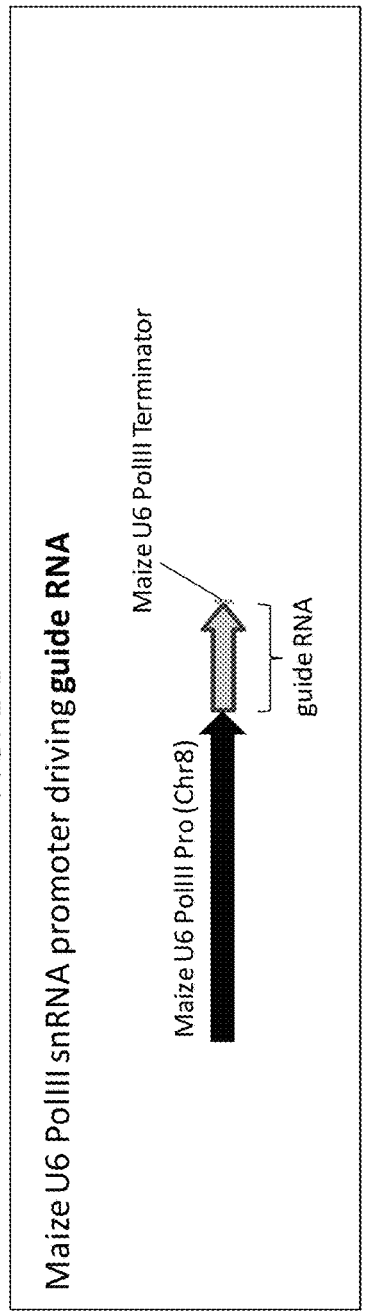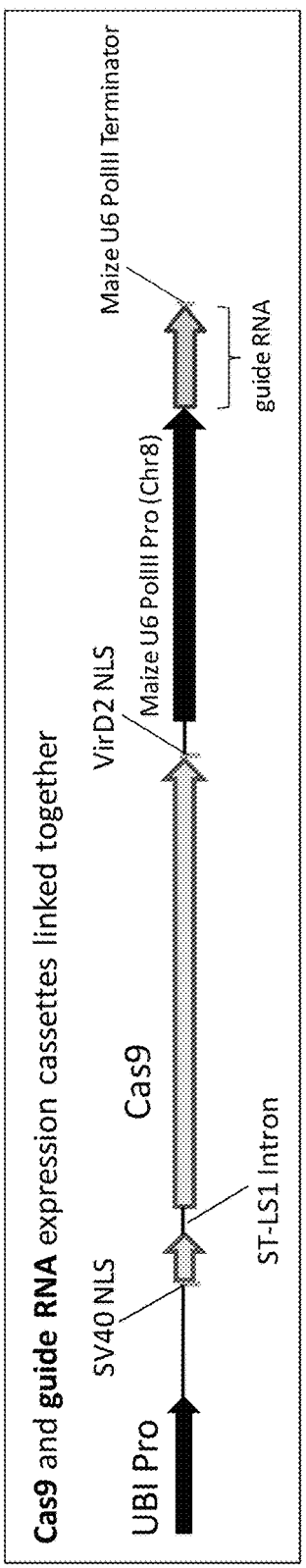

FIG. 3A

| | LIGCas-1 | | Count | SEQ ID NO: |
|---|---|---|---|---|
| Reference | CTGTAACGATTTACGCACCTGCTGGGAATTGTACGTACGCTGCCCGGCG[AGG]ATATATATACCTCACACGTACGCGTATATATAC | | | 55 |
| Mutation 1 | AGGACTGTAACGATTTACGCACCTGCTGGGAATTGTACCGTACGCTGCCCGGTCGGAGGATATATATACCTCACACGTACGCGTATATATAC | | 14488 | 56 |
| Mutation 2 | AGGACTGTAACGATTTACGCACCTGCTGGGAATTGTACCGTACGCTGCCCGGA.CGGAGGATATATATACCTCACACGTACGCGTATATATAC | | 7746 | 57 |
| Mutation 3 | AGGACTGTAACGATTTACGCACCTGCTGGGAATTGTACCGTACGCTGCCCGGCGGAGGATATATATACCTCACACGTACGCGTATATATAC | | 5028 | 58 |
| Mutation 4 | AGGACTGTAACGATTTACGCACCTGCTGGGAATTGTACCGTACGCTGCCCGGTGGGAGGATATATATACCTCACACGTACGCGTATATATAC | | 1425 | 59 |
| Mutation 5 | AGGACTGTAACGATTTACGCACCTGCTGGGAATTGTACCGTACGCTGCCCGGC--GGTCGGAGGATATATATACCTCACACGTACGCGTATATATAC | | 1056 | 60 |
| Mutation 6 | AGGACTGTAACGATTTACGCACCTGCTGGGAATTGTACCGTACGCTGCCCGG-CGGAGGATATATATACCTCACACGTACGCGTATATATAC | | 963 | 61 |
| Mutation 7 | AGGACTGTAACGATTTACGCACCTGCTGGGAATTGTACCGTACGCTGCCCCGG--GGAGGATATATATACCTCACACGTACGCGTATATATAC | | 732 | 62 |
| Mutation 8 | AGGACTGTAACGATTTACGCACCTGCTGGGAATTGTACCGTACGCTGCCCGG---AGGAGGATATATATACCTCACACGTACGCGTATATATAC | | 730 | 63 |
| Mutation 9 | AGGACTGTAACGATTTACGCACCTGCTGGGAATTGTACCGTACGCTGCCCGGC---GTCGGAGGATATATATACCTCACACGTACGCGTATATATAC | | 492 | 64 |
| Mutation 10 | AGGACTGTAACGATTTACGCACCTGCTGGGAATTGTACCGTACG------------------------TAC | | 390 | 65 |

Expected Site of Cleavage → PAM

| | LIGCas-2 | | Count | SEQ ID NO: |
|---|---|---|---|---|
| Reference | CTGTCTGTAACGATTTACGCACCTGCTGGGAATTGTACCGTACGTGCC[CGG]CGGAGGATATATATACCTCACACGTACGCGTATATATAC | | | 55 |
| Mutation 1 | TCCTCTGTAACGATTTACGCACCTGCTGGGAATTGTACCGTACGTGCCCGGCGGAGGATATATATACCTCACACGTACGCGTATATATAC | | 4221 | 66 |
| Mutation 2 | TCCTCTGTAACGATTTACGCACCTGCTGGGAATTGTACCGTACGTGACCCCGGCGGAGGATATATATACCTCACACGTACGCGTATATATAC | | 3452 | 67 |
| Mutation 3 | TCCTCTGTAACGATTTACGCACCTGCTGGGAATTGTACCGTACGT-CCCGGCGGAGGATATATATACCTCACACGTACGCGTATATATAC | | 3395 | 68 |
| Mutation 4 | TCCTCTGTAACGATTTACGCACCTGCTGGGAATTGTACCGTACGTGCCCCGGCGGAGGATATATATACCTCACACGTACGCGTATATATAC | | 1870 | 69 |
| Mutation 5 | TCCTCTGTAACGATTTACGCACCTGCTGGGAATTGTACCGTAC----CCCGGCGGAGGATATATATACCTCACACGTACGCGTATATATAC | | 1344 | 70 |
| Mutation 6 | TCCTCTGTAACGATTTACGCACCTGCTGGGAATTGTACCGTACGTA------CCCGGCGGAGGATATATATACCTCACACGTACGCGTATATATAC | | 876 | 71 |
| Mutation 7 | TCCTCTGTAACGATTTACGCACCTGCTGGGAATTGTACCGTACGTA------CCCGGCGGAGGATATATATACCTCACACGTACGCGTATATATAC | | 507 | 72 |
| Mutation 8 | TCCTCTGTAACGATTTACGCACCTGCTGGGAATTGTACCGTGAACCCGGCGGAGGATATATATACCTCACACGTACSCGTATATATAC | | 364 | 73 |
| Mutation 9 | TCCTCTGTAACGATTTACGCACCTGCTGGGAATTGTACCGTACGTG---TACGGTATATATAC | | 331 | 74 |
| Mutation 10 | TCCTCTGTAACGATTTACGCACCTGCTGGGAATTGTACCGTACG----CCCCGGCGGAGGATATATATACCTCACACGTACGCGTATATATAC | | 315 | 75 |

Expected Site of Cleavage → PAM

FIG. 3B

Expected Site of Cleavage ↓ PAM

| | LIGCas-3 | Count | SEQ ID NO: |
|---|---|---|---|
| Reference | CGCAAATGAGTAGCAGCCACGCGTATATATACGCGTACGCGTACGGGCACGCGTACGGTACAATTCCCAG | | 76 |
| Mutation 1 | AAGGCGCAAATGAGTAGCAGCCACGCGTACGCGTACGCGTGAGGTATATATATACGCGTACGGTACAATTCCCAG | 16861 | 77 |
| Mutation 2 | AAGGCGCAAATGAGTAGCAGCCACGCGTACGCGTACGCGTCCGCCGGGCACGCGTACGGTACAATTCCCAG | 3648 | 78 |
| Mutation 3 | AAGGCGCAAATGAGTAGCAGCCACGCGTACGCGTACGCGTAC-TGTGAGGTATATATATACGCCGGGCACGCGTACGGTACAATTCCCAG | 2263 | 79 |
| Mutation 4 | AAGGCGCAAATGAGTAGCAGCCACGCGTACGCGTACGCGTACG--TGAGGTATATATATACGCCGGGCACGCGTACGGTACAATTCCCAG | 2132 | 80 |
| Mutation 5 | AAGGCGCAAATGAGTAGCAGCCACGCGTACGCGTACGCGTATA-----------TCCTCCGCCGGGCACGCGTACGGTACAATTCCCAG | 1181 | 81 |
| Mutation 6 | AAGGCGCAAATGAGTAGCAGCCACGCGTACGCGTACGCGTATATA----------------CGTACGGTACGGTACAATTCCCAG | 848 | 82 |
| Mutation 7 | AAGGCGCAAATGAGTAGCAGCCACGCGTACGCGTACGCGTATATATACG--------GTGAGGTATATATATCCTCCGCCGGGCACGCGTACGGTACAATTCCCAG | 327 | 83 |
| Mutation 8 | AAGGCGCAAATGAGTAGCAGCCACGCGTACGCGTACGCGTATAT---------------CGGGGCACGCGTACGGTACAATTCCCAG | 263 | 84 |
| Mutation 9 | AAGGCGCAAATGAGTAGCAGCCACGCGTACGCGTACGCGTA---------CCCTCCGCCGGGCACGCGTACGGTACAATTCCCAG | 227 | 85 |
| Mutation 10 | AAGGCGCAAATGAGTAGCAGCCACGCGTACGCGTACGCGTA-TGTGAGGTATATATATACGCGTA-TGTGAGGTACGCGTACGGTACAATTCCCAG | 209 | 86 |

Expected Site of Cleavage ↓

| | LIG3-4 HOMING ENDONUCLEASE | Count | SEQ ID NO: |
|---|---|---|---|
| Reference | CGCAAATGAGTAGCAGCCACGCGTATATATACGCGTACGCGTACGTGTGAGGTATATATATCCTCCGCCGGGCACGCGTACGGTACAATTCCCAG | | 76 |
| Mutation 1 | CCTTCGCAAATGAGTAGCAGCCACGCGTATATATACGCGTACGCGTACGTG--AGGTATATATATACGCGTACGCGTACGGTACAATTCCCAG | 358 | 87 |
| Mutation 2 | CCTTCGCAAATGAGTAGCAGCCACGCGTATATATACGCGTATATATA----------TCCTCCGCCGGGCACGCGTACGGTACAATTCCCAG | 241 | 88 |
| Mutation 3 | CCTTCGCAAATGAGTAGCAGCCACGCGTATATATACGCGTACGCGT-------------ACGTACGGTACGCGTACGGTACAATTCCCAG | 150 | 89 |
| Mutation 4 | CCTTCGCAAATGAGTAGCAGCCACGCGTATATATACGCGTACG-------------------CGTACGGTACGCGTACGGTACAATTCCCAG | 143 | 90 |
| Mutation 5 | CCTTCGCAAATGAGTAGCAGCCACGCGTATATATACGCGTA------------------CGCCGGGCACGCGTACGGTACAATTCCCAG | 97 | 91 |
| Mutation 6 | CCTTCGCAAATGAGTAGCAGCCACGCGTATATATACGCGTGT---------GAGGTATATATATACGCGCT-----------GTACAATTCCCAG | 52 | 92 |
| Mutation 7 | CCTTCGCAAATGAGTAGCAGCCACGCGTATATATACGCGCGT-----GTGAGGTATATATATACGCGCGT---CCCTCCGCCGGGCACGCGTACGGTACAATTCCCAG | 50 | 93 |
| Mutation 8 | CCTTCGCAAATGAGTAGCAGCCACGCGTATATATACGCGTATAT-----------CCCTCCGCCGGGCACGCGTACGGTACAATTCCCAG | 46 | 94 |
| Mutation 9 | CCTTCGCAAATGAGTAGCAGCCACGCGTATATATACGCGTACGTGT--GGTATATATATACGCGTACGCGTACGGTACAATTCCCAG | 42 | 95 |
| Mutation 10 | CCTTCGCAAATGAGTAGCAGCCACGCGTATATATACGCGTACG-----GTATATACGTGTGAGGTATATATATCCTCCGCCGGGCACGCGTACGGTACA | 32 | 96 |

FIG. 6

| | 55CasRNA-1 | | SEQ ID NO: |
|---|---|---|---|
| Reference | CCGGTTTCGCTGCTCTGGCTTTACATTACACATGGGCAGGTCTCACGACGGTGGCTGGAGAGCCGGCTGGTAGGGGAGGACCTCAACGGC | | 104 |
| Mutation 1 | CCGGTTTCGCTGCTCTGGCTTTACATTACATGGGCAGGTCTCACGA-GGTTGGGCTGGAGAGCCGGCTGGTAGGGGAGGACCTCAACGGC | | 105 |
| Mutation 2 | CCGGTTTCGCTGCTCTGGCTTTACATTACATGGGCAGGTCTCAC-ACGGCTGGGCTGGAGAGCCGGCTGGTAGGGGAGGACCTCAACGGC | | 106 |
| Mutation 3 | CGGGTTTCGCTGCTCTGGCTTTACATTACATGGGCAGGTCTCACGACGGGTTTGGGCTGGAGAGCCGGCTGGTAGGGGAGGACCTCAACGGC | | 107 |
| Mutation 4 | CCGGTTTCGCTGCTCTGGCTTTACATTGCATGAGCAGGTCGT--GACGGTTGGGCTGGAGAGCCGGCTGGTAGGGGAGGACCTCAACGGC | | 108 |
| Mutation 5 | GGGCAGGTCT--CGACGGTCT--CGACGGTTGGGCTGGAGAGCCGGCTGGTAGGGGAGGACCTCAACGGC | | 109 |
| Mutation 6 | CCGGTTTCGCTGCTC------------------------------TTGGGCTGGAGAGCCGGCTGGTAGGGGAGGACCTCAACGGC | | 110 |

DD43CR1 20 bp　　　　　　　　　　　　　　　　　　　Guide RNA 76 bp　　　　　　　　　　　　　　　　Terminator

GTCCCTTGTACTTGTACGTAGTTTTAGAGCTAGAAATAGCAAGTTAAAATAAGGCTAGTCCGTTATCAACTTGAAAAAGTGGCACCGAGTCGGTGCTTTTTTT

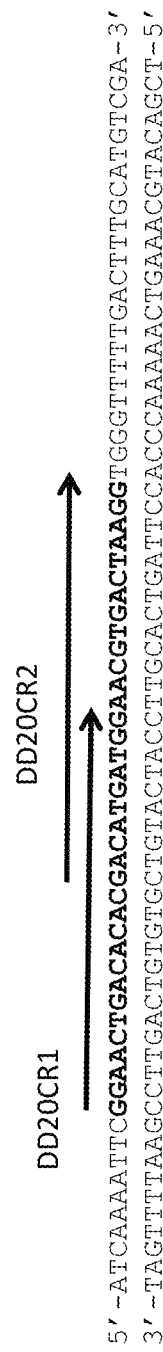
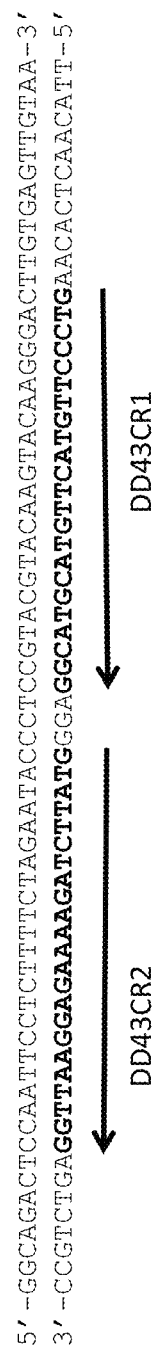
FIG. 10 A
FIG. 10 B

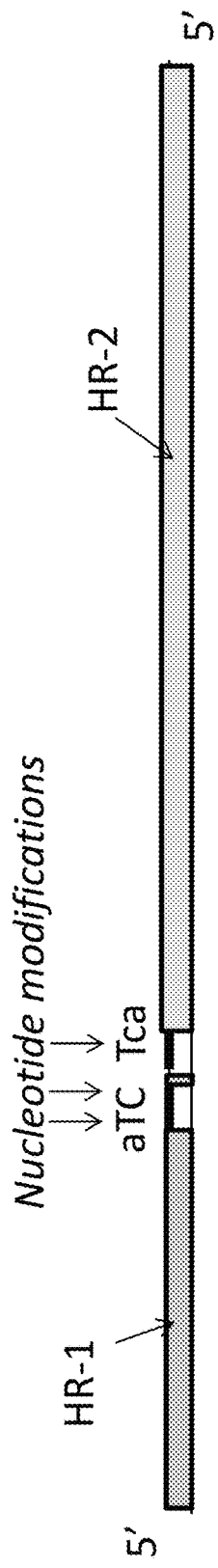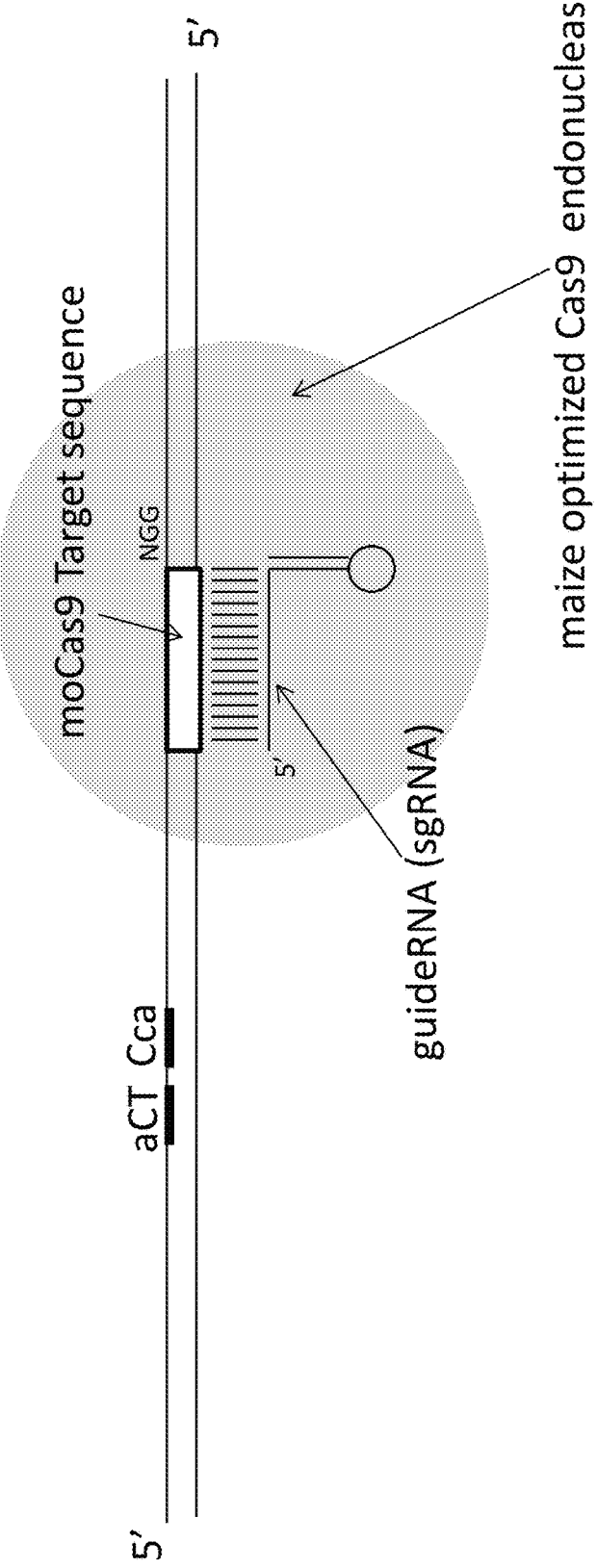

FIG. 14

*Events with intact moCas target sequence (underlined)*
SEQ ID NO: 205 GGGGAATGCTGGAACTGCAATGCGGGCCATTGACAGCAGCTGTTACTGCTGGTGGAAATGC

*Events with mutagenized moCas target sequences (underlined)*
SEQ ID NO: 206 GGGGAATGCTGGAACTGCAATGCGGGCCATTG------GCAGCTGTTACTGCTGGTGGAAATGC
SEQ ID NO: 207 GGGGAATGCTGGAACTGCA---------------CAGCAGCTGTTACTGCTGGTGGAAATGC
SEQ ID NO: 208 GGGGAATGCTG-----------------------------TTACTGCTGGTGGAAATGC

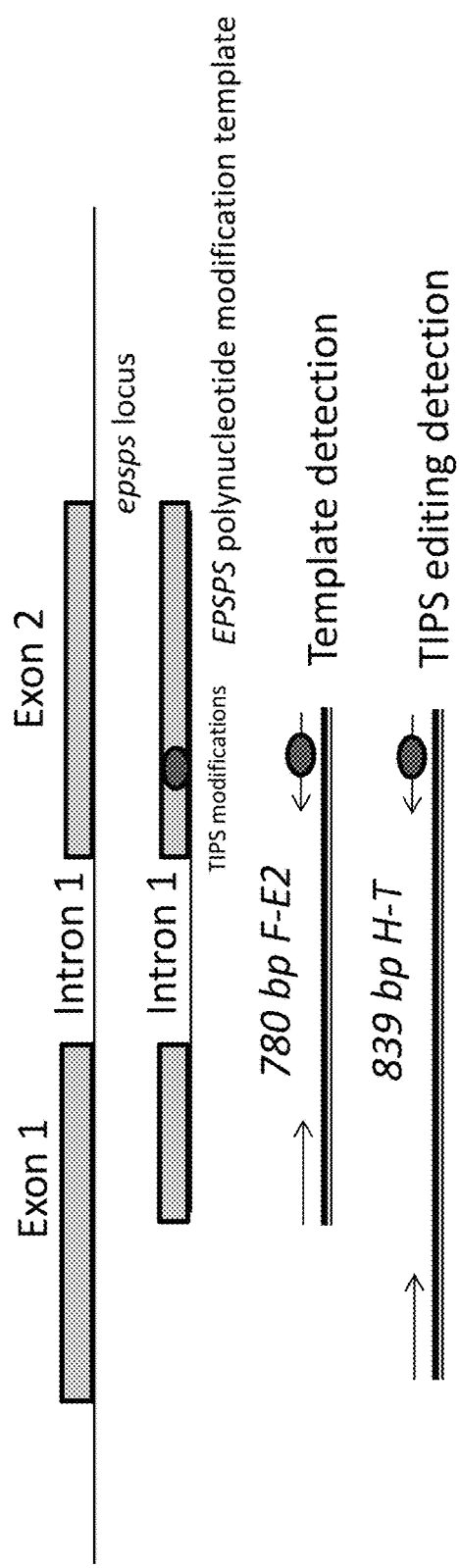
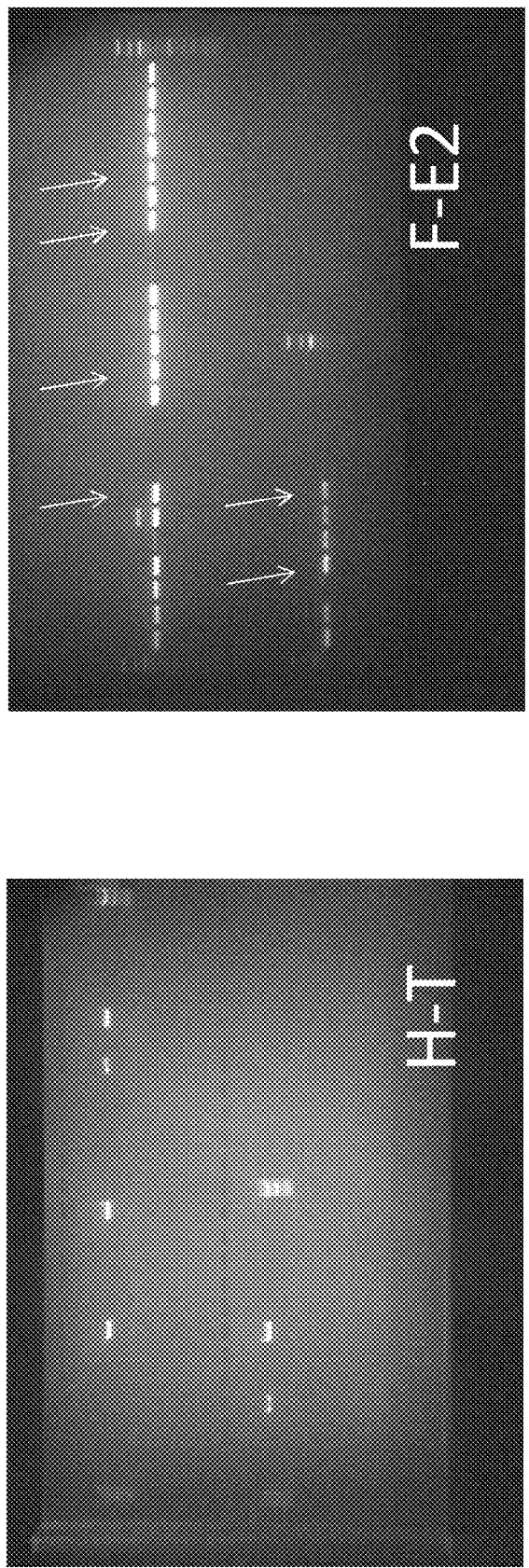
FIG. 16

FIG. 19A

A) MHP14 locus

MHP14Cas-1
→
GTTAAATCTGACGTGAATCTGTTGTT[GGT]TTGGAATTGAAAAACAAGTGCTTCCTTTCATACACCACTATGTCGCTTCAATGTTTGT    SEQ ID NO:237
CAATTTAGACTGCACTTAGACAAACCTTAACTTTTTGTTCACGAAGGAAAGTATGTGATACAGCGAAGTTACAAACA    SEQ ID NO:238
                                                        ←
                                                        MHP14Cas-3

FIG. 19B

B) TS8 locus

CCAGTACTGCACGTTACGTACGAACTAATATACTCCACCAGCTGATCACTGATGAGCCGAGC    SEQ ID NO: 239
GGTCATGACGTGCAATGCATGCATGCTTGATTATATGAGGT[GGT]CGACTAGTGACTACTCCGGCTCG    SEQ ID NO: 240
    ←                                          →
    TS8Cas-1                                   TS8Cas-2

FIG. 19C

C) TS9 locus

CCGACGTGCGCAACCTCGAGGCCGCAAACAGCC    SEQ ID NO:241
[GGC]TGCACGCACGTTGGAGCTCCGGCGTTTGTCGG    SEQ ID NO:242
     →
TS9Cas-3
←
TS9Cas-2

FIG. 19D

D) TS10 locus

GCTCGTGTTGGAGATACAG[GGA]CAGCAAGTACTTGGCCCTTAACTAGCGAAGGCGAGGCGGCCATGGA    SEQ ID NO: 243
→
TS10Cas-3
CGAGCACAAACCTCTATGTCCCTGTCGTTCATGAACC[GGG]AATTGATCGCTTCCGCCCGGTACCT    SEQ ID NO:244
                                              ←
                                              TS10Cas-1

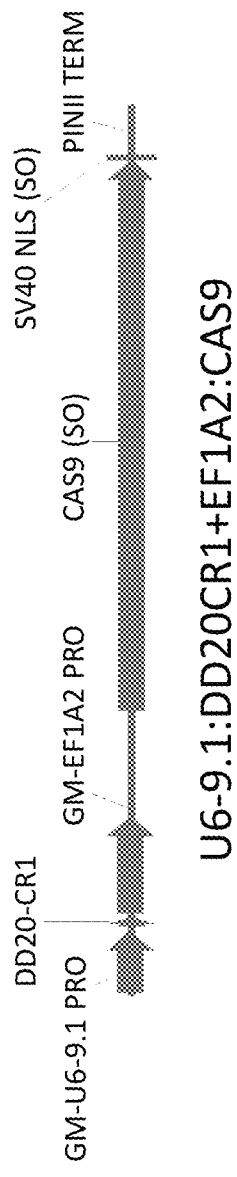
FIG. 23A  A. Linked gRNA and Cas9 gene expression cassettes
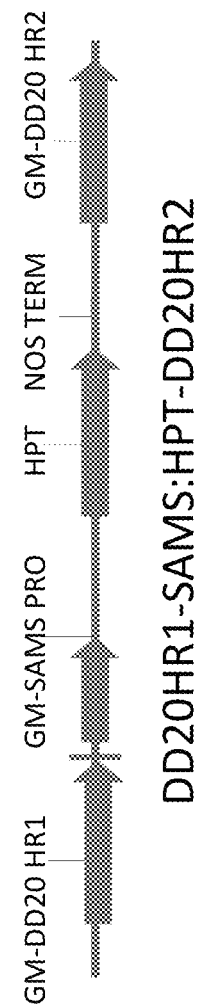
FIG. 23B  B. Repair DNA cassette with homologous regions.

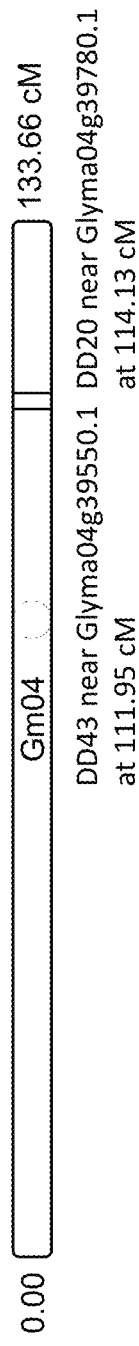
FIG. 24A  A. Diagram of Glycine max chromosome 04 indicating relative positions of DD20 and DD43 target sites.
FIG. 24B  B. DD20 qPCR amplicon, 45936307-45936370
FIG. 24C  C. DD43 qPCR amplicon, 45731879-45731993

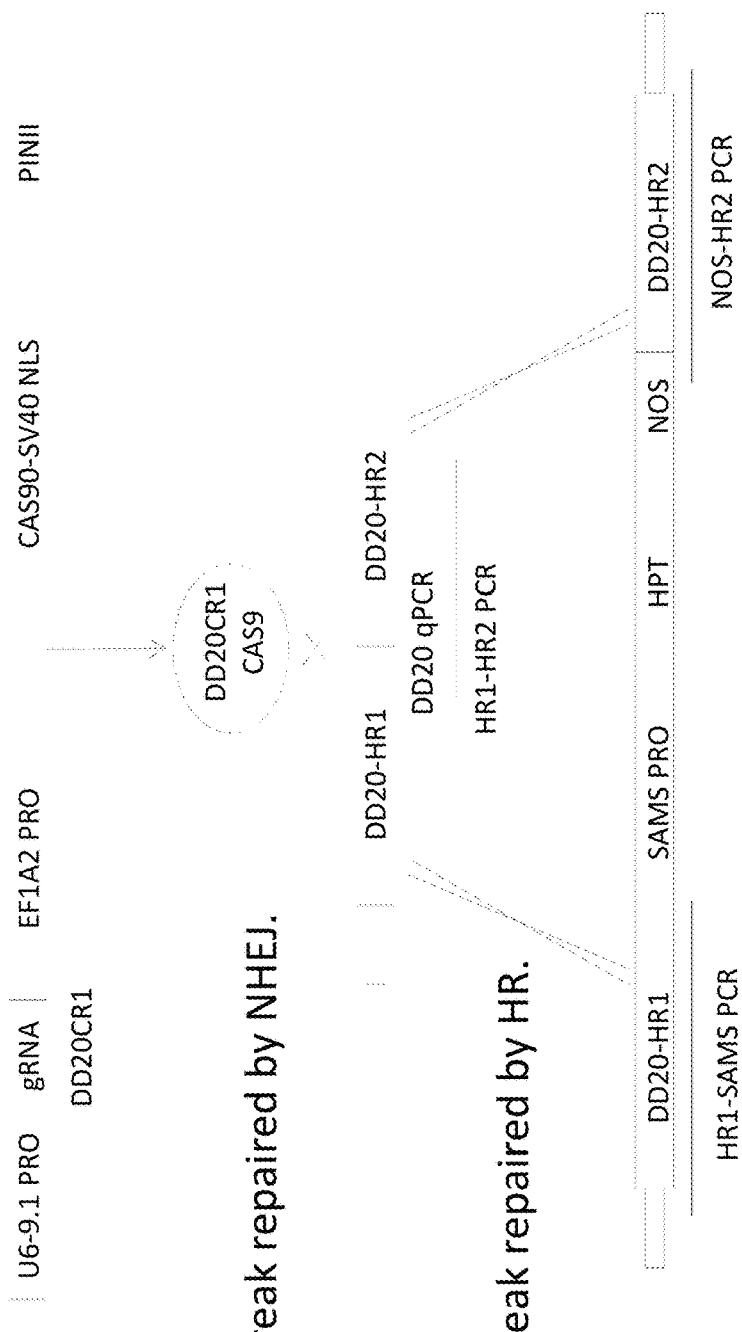

FIG. 26A

```
                DD20CR1 target site
                ┌─────────────────────────────────────┐
                ACTTGTACTTATCAAAAATTCGGAACTGACACGACATGA TGGAACGTGACTAAGGTGGG
SEQ ID NO:335   ACTTGTACTTATCAAAAATTCGGAACTGACACGACATGA-TGGAACGTGACTAAGGTGGG
SEQ ID NO:336   ACTTGTACTTATCAAAAATTCGGAACTGACACGACAC-TGATGGAACGTGACTAAGGTGGG
SEQ ID NO:337   ACTTGTACTTATCAAAAATTCGGAACTGACACGACGA-ATGATGGAACGTGACTAAGGTGGG
SEQ ID NO:338   ACTTGTACTTATCAAAAATTCGGAACTGACACGACGA--TGATGGAACGTGACTAAGGTGGG
SEQ ID NO:339   ACTTGTACTTATCAAAAATTCGGAACTGACACGACAC--GATGGAACGTGACTAAGGTGGG
SEQ ID NO:340   ACTTGTACTTATCAAAAATTCGGAACTGACACGACACGG--TGATGGAACGTGACTAAGGTGGG
SEQ ID NO:341   ACTTGTACTTATCAAAAATTCGGAACTGACACGACAC---ATGATGGAACGTGACTAAGGTGGG
SEQ ID NO:342   ACTTGTACTTATCAAAAATTCGGAACTGACACGACACG---TGATGGAACGTGACTAAGGTGGG
SEQ ID NO:343   ACTTGTACTTATCAAAAATTCGGAACTGACACGACACAG----TGATGGAACGTGACTAAGGTGGG
SEQ ID NO:344   ACTTGTACTTATCAAAAATTCGGAACTGACACGACACG----GATGGAACGTGACTAAGGTGGG
SEQ ID NO:345   ACTTGTACTTATCAAAAATTCGGAACTGACACGACACAC----GATGGAACGTGACTAAGGTGGG
SEQ ID NO:346   ACTTGTACTTATCAAAAATTCGGAACTGACACGACACA-----TGATGGAACGTGACTAAGGTGGG
SEQ ID NO:347   ACTTGTACTTATCAAAAATTCGGAACTGACACGACACAC------ATGATGGAACGTGACTAAGGTGGG
SEQ ID NO:348   ACTTGTACTTATCAAAAATTCGGAACTGACACGACAC------TGATGGAACGTGACTAAGGTGGG
SEQ ID NO:349   ACTTGTACTTATCAAAAATTCGGAACTGACACGACACG-------GATGGAACGTGACTAAGGTGGG
SEQ ID NO:350   ACTTGTACTTATCAAAAATTCGGAACTGACACGACACA--------TGATGGAACGTGACTAAGGTGGG
SEQ ID NO:351   ACTTGTACTTATCAAAAATTCGGAACTGACACGACACA---------GATGGAACGTGACTAAGGTGGG
SEQ ID NO:352   ACTTGTACTTATCAAAAATTCGGAACTGACACGACAACTG---------TGATGGAACGTGACTAAGGTGGG
SEQ ID NO:353   ACTTGTACTTATCAAAAATTCGGAACTGACACGACAC----------GAACGTGACTAAGGTGGG
SEQ ID NO:354   ACTTGTACTTATCAAAAATTCGGAACTGACACGACAC-----------GAACGTGACTAAGGTGGG
SEQ ID NO:355   ACTTGTACCTATCAAAAATTCGGAACTGACACGACTGA-----------ATGGAACGTGACTAAGGTGGG
SEQ ID NO:356   ACTTGTACTTATCAAAAATTCGGAACTGACACGACTGA-------------TGGAACGTGACTAAGGTGGG
SEQ ID NO:357   ACTTGTACTTATCAAAAATTCGGAACTGACACGACTGA-----------------GAACGTGACTAAGGTGGG
SEQ ID NO:358   ACTTGTACTTATCAAAAATTCGGAACTGACACGACACAT^TC--------------GG
SEQ ID NO:359   ACTTGTACTTATCAAAAATTCGGAAC-----------------------AAGGTGGG
SEQ ID NO:360   ACTTGTACTTATCAAAAATTCGGAAC-------------------------GTGACTAAGGTGGG
SEQ ID NO:361   ACT-------------------------------------------------ATGGAACGTGACTAAGGTGGG Insertion starts at ^ with the insert size indicated.

SEQ ID NO:362   ACTTGTACTTATCAAAA^50------TGATGGAACGTGACTAAGGTGGG
SEQ ID NO:363   ACTTGTACTTATCAAAAATTCGGAACTGACACACG^155-GATGGAACGTGACTAAGGTGGG
```

FIG. 26B

```
                    DD20CR2 target site
                    ╔══════════════════════╗↓
SEQID NO:364  GACACACGACATGATGATGGAACGTGACTAA GGTGGGTTTTTTGACTTTTGCATGTCGAAGTGAG
SEQID NO:365  GACACACGACATGATGATGGAACGTGACTAAGGTGGGTTTTTTGACTTTTGCATGTCGAAGTGAG
SEQID NO:366  GACACACGACATGATGATGGAACGTA-CTAAGGTGGGTTTTTTGACTTTTGCATGTCGAAGTGAG
SEQID NO:367  GACACACGACATGATGATGGAACGT--CTAAGGTGGGTTTTTTGACTTTTGCATGTCGAAGTGAG
SEQID NO:368  GACACACGACATGATGATGGAACGTGA---AAGGTGGGTTTTTTGACTTTTGCATGTCGAAGTGAG
SEQID NO:369  GACACACGACATGATGATGGAACG----CTAAGGTGGGTTTTTTGACTTTTGCATGTCGAAGTGAG
SEQID NO:370  GACACACGACATGATGATGGAACGTG-----AAGGTGGGTTTTTTGACTTTTGCATGTCGAAGTGAG
SEQID NO:371  GACACACGACATGATGATGGAACGTG------AGGTGGGTTTTTTGACTTTTGCATGTCGAAGTGAG
SEQID NO:372  GACACACGACATGATGATGGAACG------TAAGGTGGGTTTTTTGACTTTTGCATGTCGAAGTGAG
SEQID NO:373  GACACACGACATGATGATGGAAC-------CTAAGGTGGGTTTTTTGACTTTTGCATGTCGAAGTGAG
SEQID NO:374  GACACACGACATGATGATGGAACGTG------AGGTGGGTTTTTTGACTTTTGCATGTCGAAGTGAG
SEQID NO:375  GACACACGACATGATGATGGAA---------CTAAGGTGGGTTTTTTGACTTTTGCATGTCGAAGTGAG
SEQID NO:376  GACACACGACATGATGATGGAA----------TAAGGTGGGTTTTTTGACTTTTGCATGTCGAAGTGAG
SEQID NO:377  GACACACGACATGATGATGG-----------CTAAGGTGGGTTTTTTGACTTTTGCATGTCGAAGTGAG
SEQID NO:378  GACACACGACATGATGATGGA-----------TAAGGTGGGTTTTTTGACTTTTGCATGTCGAAGTGAG
SEQID NO:379  GACACACGACATGATGATGGA-------------AGGTGGGTTTTTTGACTTTTGCATGTCGAAGTGAG
SEQID NO:380  GACACACGACATGATGATGG--------------AGGTGGGTTTTTTGACTTTTGCATGTCGAAGTGAG
SEQID NO:381  GACACACGACATGATGATGG---------------GTTTTTGACTTTTGCATGTCGAAGTGAG
SEQID NO:382  GACACACGACAC-----------------------AGGTGGGTTTTTTGACTTTTGCATGTCGAAGTGAG
SEQID NO:383  GACAC-----------------------------TAAGGTGGGTTTTTTGACTTTTGCATGTCGAAGTGAG
SEQID NO:384  GACACACGACATGATGATGGAAC--------------------------------------GTGAG
SEQID NO:385  GACACACGACATGATGATGG----------133bp deletion----------------------
```

FIG. 26C

DD43CR1 target site

```
SEQID NO:386  AGCCCTTACAACTCACAAGTCCCTTGTACTTGTACGTA|GGAGGGTATTCTAGAAAAGAGG
SEQID NO:387  AGCCCTTACAACTCACAAGTCCCTTGTACTTGTACGTA-CGGAGGGTATTCTAGAAAAGAGG
SEQID NO:388  AGCCCTTACAACTCACAAGTCCCTTGTACTTGTAC--TACGGAGGGTATTCTAGAAAAGAGG
SEQID NO:389  AGCCCTTACAACTCACAAGTCCCTTGTACTTGTA-GTACGGAGGGTATTCTAGAAAAGAGG
SEQID NO:390  AGCCCTTACAACTCACAAGTCCCTTGTACTTGT---GTACGGAGGGTATTCTAGAAAAGAGG
SEQID NO:391  AGCCCTTACAACTCACAAGTCCCTTGTACTTG----CGTACGGAGGGTATTCTAGAAAAGAGG
SEQID NO:392  AGCCCTTACAACTCACAAGTCCCTTGTACTTG-----GTACGGAGGGTATTCTAGAAAAGAGG
SEQID NO:393  AGCCCTTACAACTCACAAGTCCCTTGTACTTGT-----TACGGAGGGTATTCTAGAAAAGAGG
SEQID NO:394  AGCCCTTACAACTCACAAGTCCCTTGTACTT------GTACGGAGGGTATTCTAGAAAAGAGG
SEQID NO:395  AGCCCTTACAACTCACAAGTCCCTTGTACTT-------TACGGAGGGTATTCTAGAAAAGAGG
SEQID NO:396  AGCCCTTACAACTCACAAGTCCCTTGTACT--------GTACGGAGGGTATTCTAGAAAAGAGG
SEQID NO:397  AGCCCTTACAACTCACAAGTCCCTTGTACT---------TACGGAGGGTATTCTAGAAAAGAGG
SEQID NO:398  AGCCCTTACAACTCACAAGTCCCTTGTA----------GTACGGAGGGTATTCTAGAAAAGAGG
SEQID NO:399  AGCCCTTACAACTCACAAGTCCCTTGT------------TACGGAGGGTATTCTAGAAAAGAGG
SEQID NO:400  AGCCCTTACAACTCACAAGTCCCTTG-------------TACGGAGGGTATTCTAGAAAAGAGG
SEQID NO:401  AGCCCTTACAACTCACAAGCCCCTT--------------TACGGAGGGTATTCTAGAAAAGAGG
SEQID NO:402  AGCCCTTACAACTCACAAGTCCCT---------------TACGGAGGGTATTCTAGAAAAGAGG
SEQID NO:403  AGCCCTTACAACTCACAAGTCCC----------------TACGGAGGGTATTCTAGAAAAGAGG
SEQID NO:404  AGCCCTTACAACTCACAAGTCCCTTGTACTTGTA-----------AGAAAAGAGG
```

Insertion starts at ^ with the insert size indicated.

```
SEQID NO:405  AGCCCTTACAACTCACAAGTCCCTTGTACTTGTA-----TAAATTAA^AGGTTATTCTAGAAAAGAGG
SEQID NO:406  AGCCCTTACAACTCACAAGTCCCTTGTACTTGTAC^167GTACGGAGGGTATTCTAGAAAAGAGG
SEQID NO:407  AGCCCTTACAACTCACAAGTCCCTTGTACTTGTA^38--GTACGGAGGGTATTCTAGAAAAGAGG
SEQID NO:408  AGCCCTTACAACTCACAAGTCCCTTGTACTTGTA^130-----GTACGGAGGGTATTCTAGAAAAGAGG
SEQID NO:409  AGCCCTTACAACTCACAAGTCCCTTGTACTTGTAC^171GTACGGAGGGTATTCTAGAAAAGAGG
SEQID NO:410  AGCCCTTACAACTCACAAGTCCCTTGTACTTGTAC^220GTACGGAGGGTATTCTAGAAAAGAGG
SEQID NO:411  AGCCCTTACAACTCACAAGTCCCTT^110---------GTACGGAGGGTATTCTAGAAAAGAGG
SEQID NO:412  AGCCCTTACAACTCACAAGTCCCTTGTACTTGTAC^190GTACGGAGGGTATTCTAGAAAAGAGG
SEQID NO:413  AGCCCTTACAACTCACAAGTCCCTTGTACTTGTAC^125GTACGGAGGGTATTCTAGAAAAGAGG
SEQID NO:414  AGCCCTTACAACTCACAAGTCCCTTGTACTTGTA^177-----GAGGGTATTCTAGAAAAGAGG
```

FIG. 27 A

| LIGCas-1 | | Count | SEQ ID NO: |
|---|---|---|---|
| CTGTAACGATTACGCACCTGCTGGGAATTGTACCGTACGTGCCCCGGGCGAGGATATATATACCTCACACGTACGCGTATATATAC | | | 55 |
| TCCTCTGTAACGATTACGCACCTGCTGGGAATTGTACCGTACGTGCCCCGGGCGAGGATATATATACCTCACACGTACGCGTATATATAC | | 2116 | 415 |
| TCCTCTGTAACGATTACGCACCTGCTGGGAATTGTACCGTACGTGCCCCGGGTCGGAGGATATATATACCTCACACGTACGCGTATATATAC | | 1156 | 416 |
| TCCTCTGTAACGATTACGCACCTGCTGGGAATTGTACCGTACGTGCCCCGGGACGGAGGATATATATACCTCACACGTACGCGTATATATAC | | 473 | 417 |
| TCCTCTGTAACGATTACGCACCTGCTGGGAATTGTACCGTACGTGCCCCGGGGCGGAGGATATATATACCTCACACGTACGCGTATATATAC | | 161 | 418 |
| TCCTCTGTAACGATTACGCACCTGCTGGGAATTGTACCGTACGTGCCCCGGGCCGGAGGATATATATACCTCACACGTACGCGTATATATAC | | 133 | 419 |
| TCCTCTGTAACGATTACGCACCTGCTGGGAATTGTACCGTACGTGCCCCGGGATCGGAGGATATATATACCTCACACGTACGCGTATATATAC | | 82 | 420 |
| TCCTCTGTAACGATTACGCACCTGCTGGGAATTGTACCGTACGTGCCCCGG----AGGATATATATACCTCACACGTACGCGTATATATAC | | 77 | 421 |
| TCCTCTGTAACGATTACGCACCTGCTGGGAATTGTACCGTACGTGCCCCGG--------TTCACACGTACGCGTATATATAC | | 55 | 422 |
| TCCTCTGTAACGATTACGCACCTGCTGGGAATTGTACCGTACGTGCCCCGGGTTCGGAGGATATATATACCTCACACGTACGCGTATATATAC | | 39 | 423 |
| TCCTCTGTAACGATTACGCACCTGCTGGGAATTGTACCGTACGTGCCCC---CGGAGGATATATATACCTCACACGTACGCGTATATATAC | | 39 | 424 |

Expected Site of Cleavage → PAM

FIG. 27C

| LIGCas-3 | | Count | SEQ ID NO: |
|---|---|---|---|
| CGCAAATGAGTAGCAGCGCACGTATATATACGCGTACGCGTACGTGTATATATATCCTCCGCCGGGCACGTACGGTACAATTCCCAG | | | 76 |
| AAGGCGCAAATGAGTAGCAGCGCACGTATATATACGCGTACGCGTACGTGTGAGGTATATATATCCTCCGCCGGGCACGTACGGTACAATTCCCAG | | 1208 | 435 |
| AAGGCGCAAATGAGTAGCAGCGCACGTATATATACGCGTACGCGTACG-GTGAGGTATATATATCCTCCGCCGGGCACGTACGGTACAATTCCCAG | | 453 | 436 |
| AAGGCGCAAATGAGTAGCAGCGCACGTATATATACGCGTACGCGTACGT--GAGGTATATATATCCTCCGCCGGGCACGTACGGTACAATTCCCAG | | 338 | 437 |
| AAGGCGCAAATGAGTAGCAGCGCACGTATATATACGCGTACGCGTACGTAC-TGTGAGGTATATATATCCTCCGCCGGGCACGTACGGTACAATTCCCAG | | 145 | 438 |
| AAGGCGCAAATGAGTAGCAGCGCACGTATATATACGCGTACGCGTATATA----------TCCTCCGCCGGGCACGTACGGTACAATTCCCAG | | 94 | 439 |
| AAGGCGCAAATGAGTAGCAGCGCACGTATATATACGCGTACGCGT-----GTGAGGTATATATATCCTCCGCCGGGCACGTACGGTACAATTCCCAG | | 53 | 440 |
| AAGGCGCAAATGAGTAGCAGCGCACGTATATATACGCGTACGCG----TGAGGTATATATATCCTCCGCCGGGCACGTACGGTACAATTCCCAG | | 42 | 441 |
| AAGGCGCAAATGAGTAGCAGCGCACGTATATATACGCGTACGCGTAC----------TATATATATATCCTCCGCCGGGCACGTACGGTACAATTCCCAG | | 37 | 442 |
| AAGGCGCAAATGAGTAGCAGCGCACGTATATATACGCGTACGCGTACG---GAGGTATATATATCCTCCGCCGGGCACGTACGGTACAATTCCCAG | | 20 | 443 |
| AAGGCGCAAATGAGTAGCAGCGCACGTATATATACGCGTACGCGTACG-ATGAGGTATATATATCCTCCGCCGGGCACGTACGGTACAATTCCCAG | | 19 | 444 |

Expected Site of Cleavage → PAM

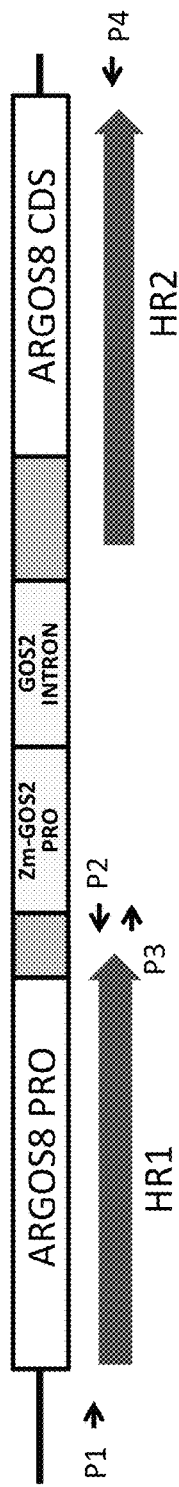
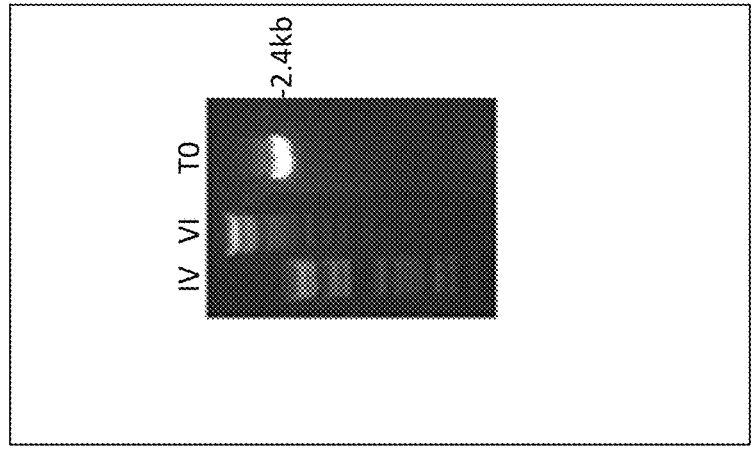
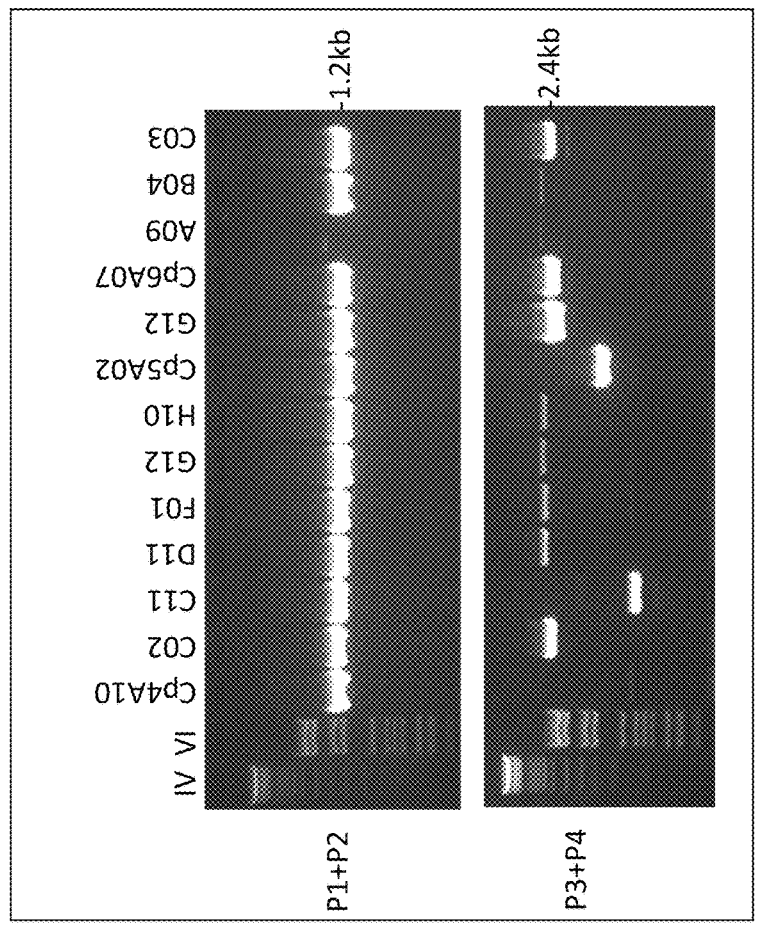
Fig. 29A
Fig. 29C
Fig. 29B

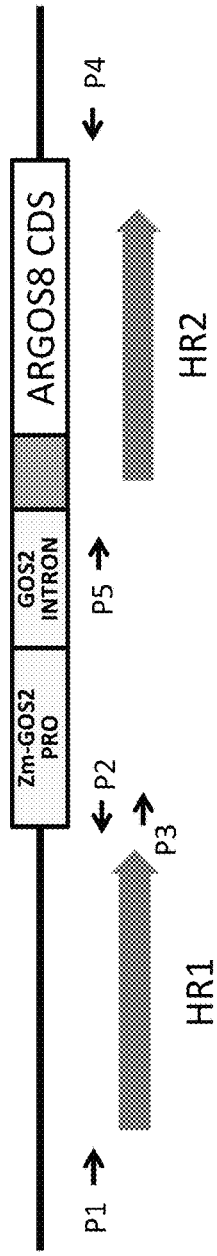
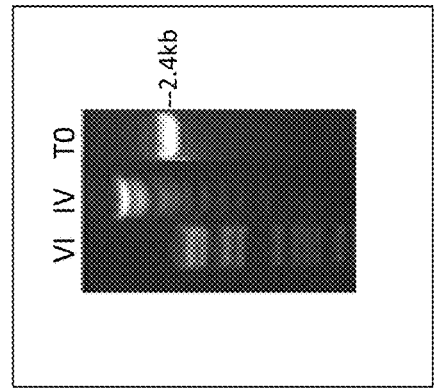
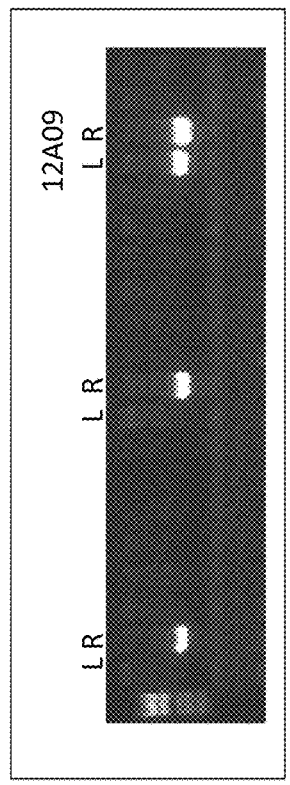
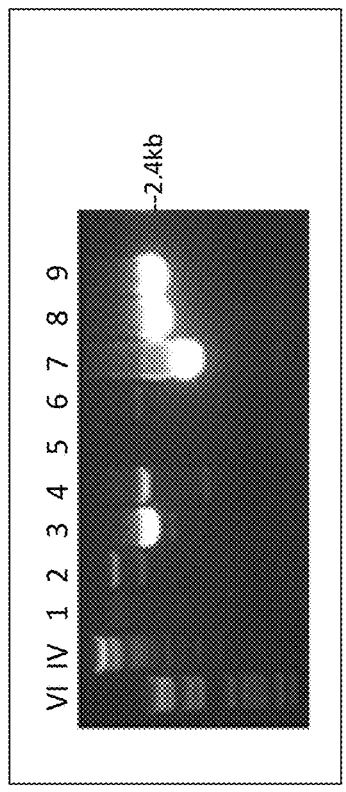
Fig. 31A
Fig. 31B
Fig. 31C
Fig. 31D

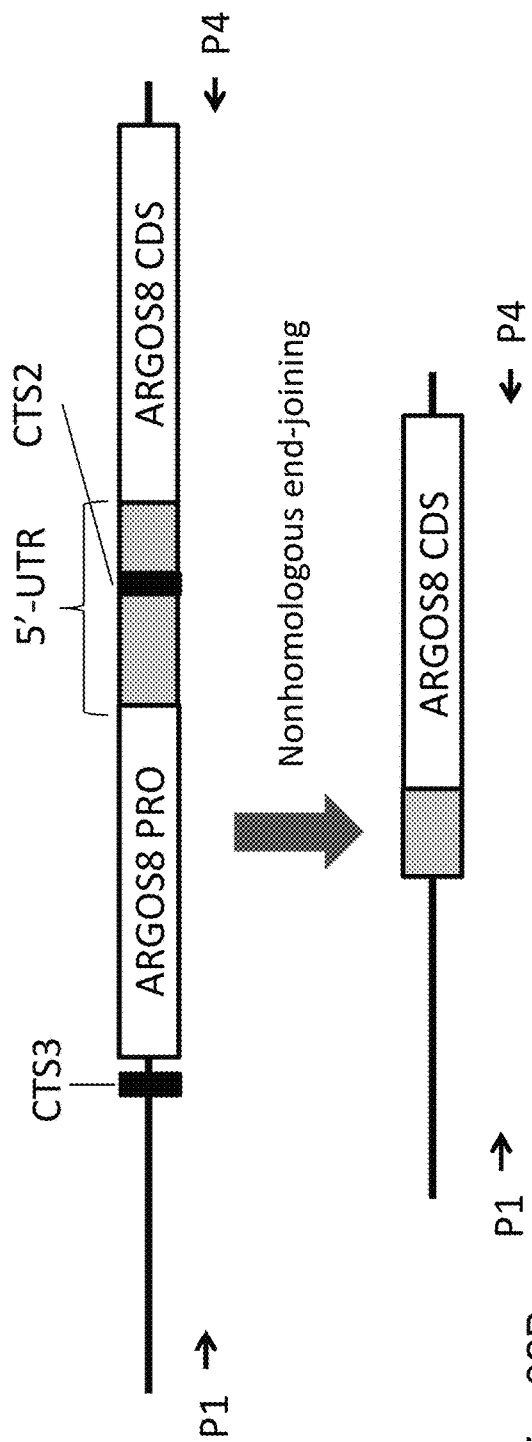
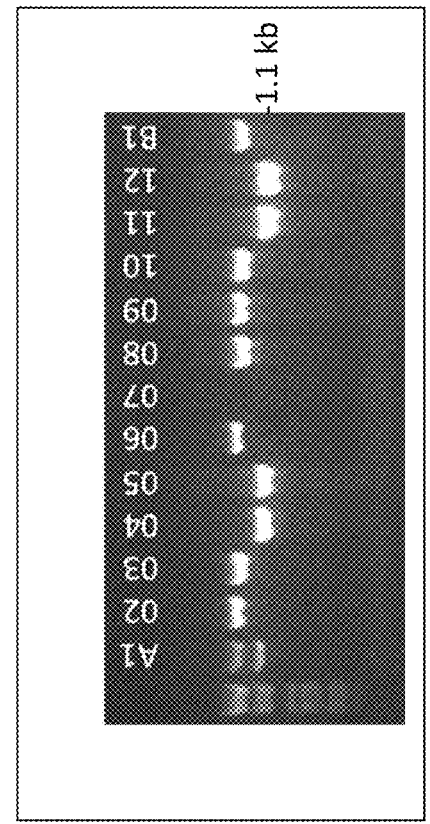
Fig. 32A
Fig. 32B

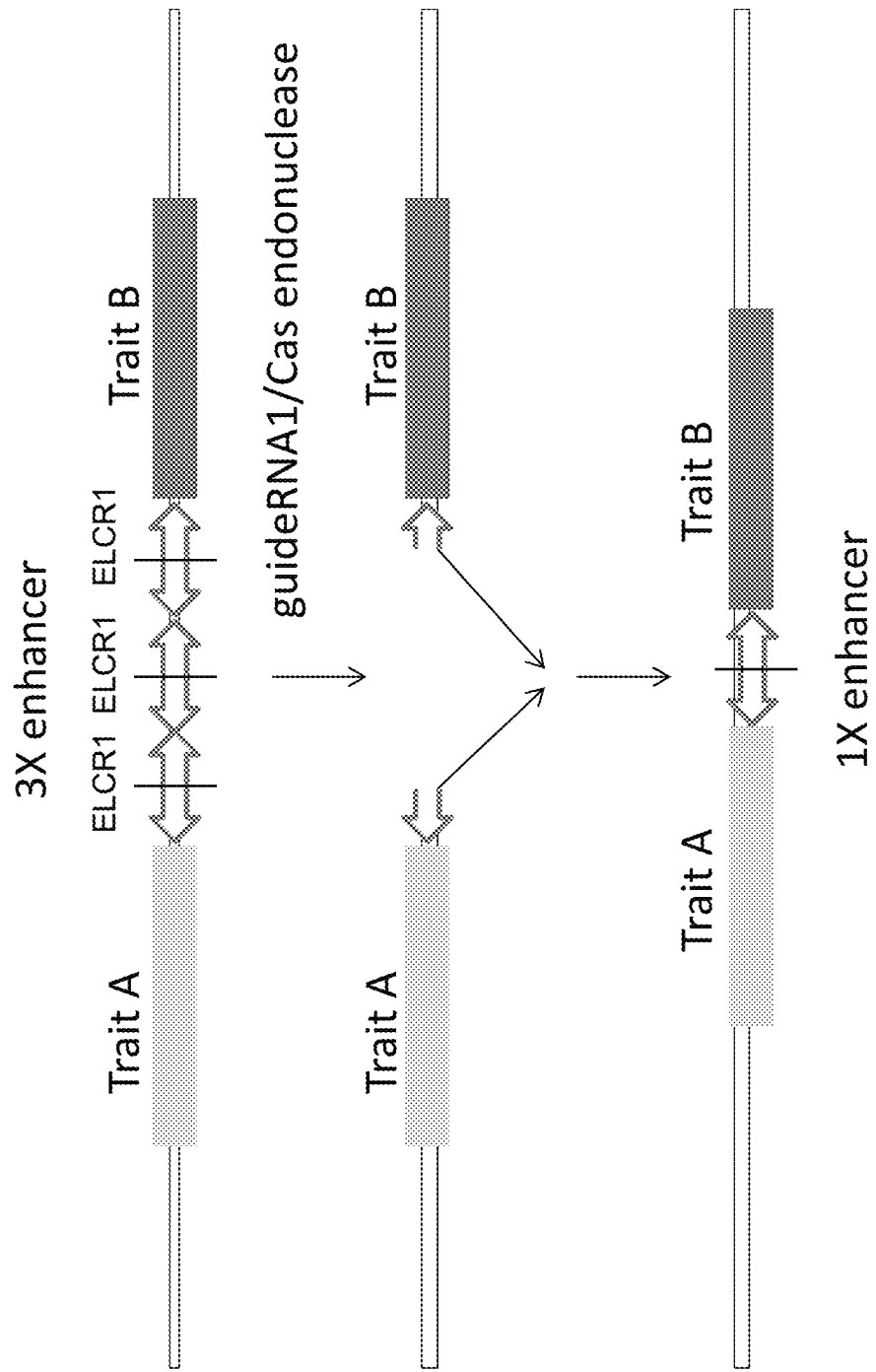

Fig. 34 A

| | |
|---|---|
| VEDAKEEV | Maize |
| GKESKEEI | Petunia |
| GKKSEEEI | Tomato |
| EKDAKEEV | Sorghum |
| VEDSKEEV | Rice |
| GKDGKEEI | Amarathus |

Fig. 34 B

```
                    T                        P   moCas9 target sequence
K
GCTAAAGAGGAAGTGCAGCTCTTCTTGGGAATGCTGGAACTGCAATGCGGCCATTGACAGCAGCTGTTACTGCTGCTGG
```

Fig. 34 C

```
                    I                        S   moCas9 target sequence
R
GCTAGAGAGGAAGTGCAGCTCTTCTTGGGAATGCTGGAATGCGGTCATTGACAGCAGCTGTTACTGCTGCTGG
```

Fig. 35 A

CATATCTG

Fig. 35 B

CATCTC...ACGATCAGAT..GCACCGCATGTCGCATGCCTA

Fig. 35 C

CATATCTGCACCGCATGTCGCATGCCTA
CATATCTGCACCGCATGTCGCATATCTG

METHODS FOR PRODUCING GENETIC MODIFICATIONS IN A PLANT GENOME WITHOUT INCORPORATING A SELECTABLE TRANSGENE MARKER, AND COMPOSITIONS THEREOF

This application claims the benefit of U.S. application Ser. No. 14/913,607 filed Feb. 22, 2016 (with U.S. Publication Number 2016208271) now allowed, which is a 371 National Stage Entry of International Patent Application PCT/US14/S1782 filed 20 Aug. 2014, which claims the benefit of U.S. Provisional Application No. 61/868,706, filed Aug. 22, 2013, U.S. Provisional Application No. 61/882,532, filed Sep. 25, 2013, U.S. Provisional Application No. 61/937,045, filed Feb. 7, 2014, U.S. Provisional Application No. 61/953,090, filed Mar. 14, 2014, and U.S. Provisional Application No. 62/023,239, filed Jul. 11, 2014; all of which are hereby incorporated herein in their entirety by reference.

FIELD

The disclosure relates to the field of plant molecular biology, in particular, to methods for altering the genome of a plant cell.

REFERENCE TO SEQUENCE LISTING SUBMITTED ELECTRONICALLY

The official copy of the sequence listing is submitted electronically via EFS-Web as an XML formatted sequence listing with a file named 115510-US-CON-1.xml created on Jul. 18, 2023 and having a size of 945 kilobytes and is filed concurrently with the specification. The sequence listing contained in this XML formatted document is part of the specification and is herein incorporated by reference in its entirety.

BACKGROUND

Recombinant DNA technology has made it possible to insert foreign DNA sequences into the genome of an organism, thus, altering the organism's phenotype. The most commonly used plant transformation methods are *Agrobacterium* infection and biolistic particle bombardment in which transgenes integrate into a plant genome in a random fashion and in an unpredictable copy number. Thus, efforts are undertaken to control transgene integration in plants.

One method for inserting or modifying a DNA sequence involves homologous DNA recombination by introducing a transgenic DNA sequence flanked by sequences homologous to the genomic target. U.S. Pat. No. 5,527,695 describes transforming eukaryotic cells with DNA sequences that are targeted to a predetermined sequence of the eukaryote's DNA. Specifically, the use of site-specific recombination is discussed. Transformed cells are identified through use of a selectable marker included as a part of the introduced DNA sequences.

It was shown that artificially induced site-specific genomic double-stranded breaks in plant cells were repaired by homologous recombination with exogenously supplied DNA using two different pathways. (Puchta et al., (1996) *Proc. Natl. Acad. Sci. USA* 93:5055-5060; U.S. Patent Application Publication No. 2005/0172365A1 published Aug. 4, 2005; U.S. Patent Application Publication No. 2006/0282914 published Dec. 14, 2006; WO 2005/028942 published Jun. 2, 2005).

Since the isolation, cloning, transfer and recombination of DNA segments, including coding sequences and non-coding sequences, is most conveniently carried out using restriction endonuclease enzymes. Much research has focused on studying and designing endonucleases such as WO 2004/067736 published Aug. 12, 2004; U.S. Pat. No. 5,792,632 issued to Dujon et al., Aug. 11, 1998; U.S. Pat. No. 6,610,545 B2 issued to Dujon et al., Aug. 26, 2003; Chevalier et al., (2002) *Mol Cell* 10:895-905; Chevalier et al., (2001) *Nucleic Acids Res* 29:3757-3774; Seligman et al., (2002) *Nucleic Acids Res* 30:3870-3879.

Although several approaches have been developed to target a specific site for modification in the genome of a plant, there still remains a need for more efficient and effective methods for producing a fertile plant, having an altered genome comprising specific modifications in a defined region of the genome of the plant.

There remains a need to develop a genetic modification system that can modify a genomic location without incorporating a selectable transgene marker.

BRIEF SUMMARY

Compositions and methods are provided employing a guide polynucleotide/Cas endonuclease system in plants for genome modification of a target sequence in the genome of a plant or plant cell, for selecting plants, for gene editing, and for inserting a polynucleotide of interest into the genome of a plant without incorporating a selectable transgene marker.

The methods and compositions employ a guide polynucleotide/Cas endonuclease system to provide for an effective system for modifying or altering target sites and nucleotide of interest within the genome of a plant, plant cell or seed without incorporating a selectable transgene marker.

Once a genomic target site is identified, a variety of methods can be employed to further modify the target sites such that they contain a variety of polynucleotides of interest. Breeding methods and methods for selecting plants utilizing a two component RNA guide and Cas endonuclease system are also disclosed. Also provided are nucleic acid constructs, plants, plant cells, explants, seeds and grain having the guide polynucleotide/Cas endonuclease system. The methods and compositions employ a guide polynucleotide/Cas endonuclease system to provide for an effective system for modifying or altering target sites and editing nucleotide sequences of interest within the genome of a cell, wherein the guide polynucleotide is comprised of a RNA sequence, a DNA sequence, or a DNA-RNA combination sequence.

Thus in one embodiment of the disclosure, the method comprises a method for producing a genetic modification into a second gene of a plant genome without introducing an exogenous selectable marker into said plant genome, the method comprising providing a first guide polynucleotide, a polynucleotide modification template, a second guide polynucleotide, and a Cas endonuclease to a plant cell comprising a first endogenous gene that can be modified to confer herbicide resistance, wherein said first guide polynucleotide and Cas endonuclease are capable of forming a first complex that enables the Cas endonuclease to introduce a double strand break at a first target site, located in or near said first endogenous gene in the genome of said plant cell, wherein said second guide polynucleotide and Cas endonuclease are capable of forming a second complex that enables the Cas endonuclease to introduce a double strand break at a second target site in the genome of said plant cell, wherein said polynucleotide modification template comprises at least one nucleotide alteration when compared to the first endogenous gene.

In one embodiment of the disclosure, the method comprises a method for introducing a polynucleotide of interest into a plant genome without introducing an exogenous selectable marker into said plant genome, the method comprising providing a first guide RNA, a first polynucleotide modification template, a second guide RNA, a second polynucleotide modification template, and a Cas endonuclease to a plant cell comprising a first endogenous gene that can be modified to confer herbicide resistance, wherein said first guide RNA and Cas endonuclease are capable of forming a first complex that enables the Cas endonuclease to introduce a double strand break at a first target site located in or near said first endogenous gene in the genome of said plant cell, wherein said first polynucleotide modification template comprises at least one nucleotide modification of said first endogenous gene to render said endogenous gene capable of conferring herbicide resistance to a plant cell, wherein said second guide RNA and Cas endonuclease are capable of forming a second complex that enables the Cas endonuclease to introduce a double strand break at a second target site in the genome of said plant cell, wherein said second polynucleotide modification template comprises at least one polynucleotide of interest to be introduced into said plant genome.

In one embodiment of the disclosure, the method comprises a method for editing a second gene of a plant genome without introducing an exogenous selectable marker into said plant genome, the method comprising providing a first guide RNA, a first polynucleotide modification template, a second guide RNA, a second polynucleotide modification template, and a Cas endonuclease to a plant cell comprising a first endogenous gene that can be modified to confer herbicide resistance, wherein said first guide RNA and Cas endonuclease are capable of forming a complex that enables the Cas endonuclease to introduce a double strand break at a first target site (located in or near said first endogenous gene) in the genome of said plant cell, wherein said first polynucleotide modification template comprises at least one nucleotide modification of said first endogenous gene to render said endogenous gene capable of conferring herbicide resistance to a plant cell, wherein said second guide RNA and Cas endonuclease are capable of forming a complex that enables the Cas endonuclease to introduce a double strand break at a second target site (located at a different locus than said first endogenous gene) in the genome of said plant cell, wherein said second polynucleotide modification template comprises at least one nucleotide alteration when compared to the second gene to be edited.

Additional embodiments of the methods and compositions of the present invention are disclosed herein.

BRIEF DESCRIPTION OF THE DRAWINGS AND THE SEQUENCE LISTING

The disclosure can be more fully understood from the following detailed description and the accompanying drawings and Sequence Listing, which form a part of this application. The sequence descriptions and sequence listing attached hereto comply with the rules governing nucleotide and amino acid sequence disclosures in patent applications as set forth in 37 C.F.R. §§ 1.821-1.825. The sequence descriptions contain the three letter codes for amino acids as defined in 37 C.F.R. §§ 1.821-1.825, which are incorporated herein by reference.

FIGURES

FIG. 1A shows a maize optimized Cas9 gene (encoding a Cas9 endonuclease) containing a potato ST-LS1 intron, a SV40 amino terminal nuclear localization sequence (NLS), and a VirD2 carboxyl terminal NLS, operably linked to a plant ubiquitin promoter (SEQ ID NO: 5). The maize optimized Cas9 gene (just Cas9 coding sequence, no NLSs) corresponds to nucleotide positions 2037-2411 and 2601-6329 of SEQ ID NO: 5 with the potato intron residing at positions 2412-2600 of SEQ ID NO: 5.SV40 NLS is at positions 2010-2036 of SEQ ID NO: 5. VirD2 NLS is at positions 6330-6386 of SEQ ID NO: 5. FIG. 1 B shows a long guide RNA operably linked to a maize U6 polymerase III promoter terminating with a maize U6 terminator (SEQ ID NO: 12). The long guide RNA containing the variable targeting domain corresponding to the maize LIGCas-3 target site (SEQ ID NO: 8) is transcribed from/corresponds to positions 1001-1094 of SEQ ID NO: 12. FIG. 1 C shows the maize optimized Cas9 and long guide RNA expression cassettes combined on a single vector DNA (SEQ ID NO: 102).

Figure 2:
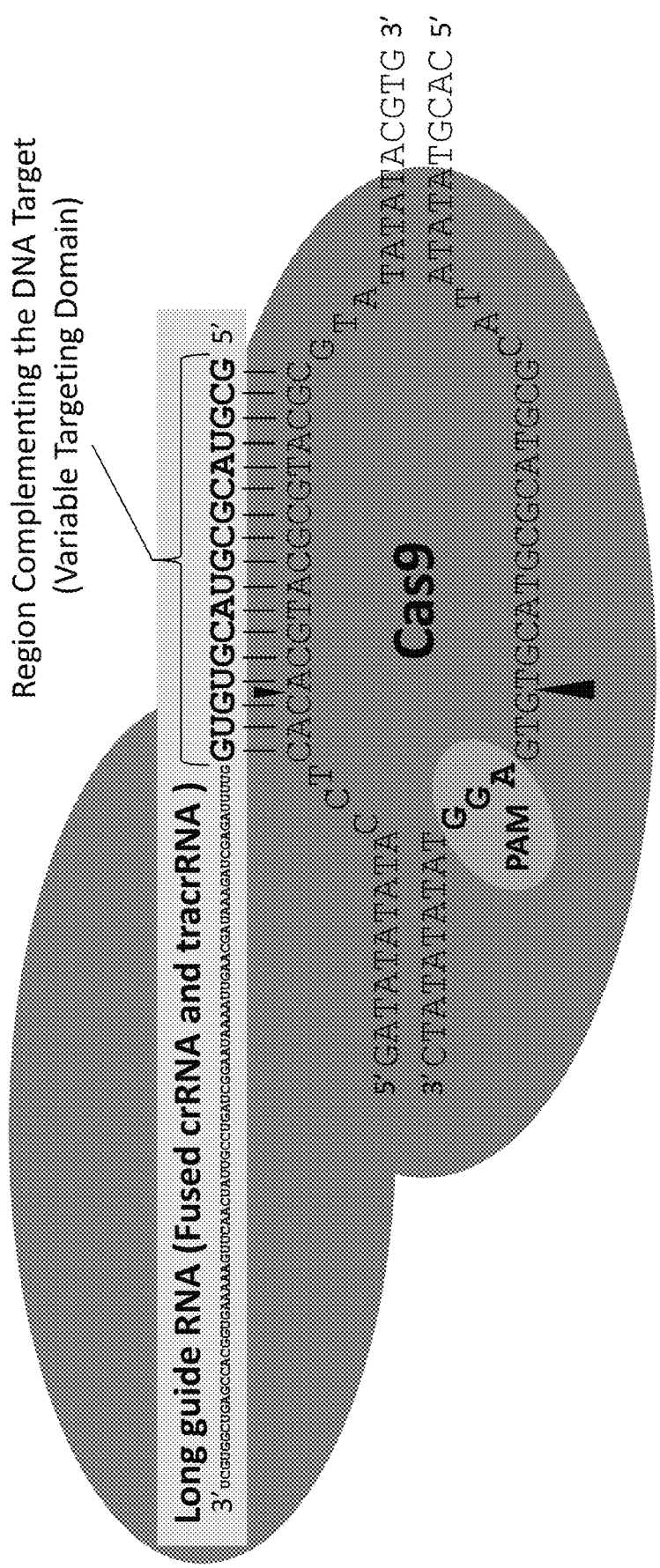

FIG. 2A illustrates the duplexed crRNA (SEQ ID NO:6)-tracrRNA (SEQ ID NO:7)/Cas9 endonuclease system and target DNA complex relative to the appropriately oriented PAM sequence at the maize LIGCas-3 (SEQ ID NO: 18, Table 1) target site with triangles pointing towards the expected site of cleavage on both sense and anti-sense DNA strands. FIG. 2 B illustrates the guide RNA/Cas9 endonuclease complex interacting with the genomic target site relative to the appropriately oriented PAM sequence (GGA) at the maize genomic LIGCas-3 target site (SEQ ID NO:18, Table 1). The guide RNA (shown as boxed-in in light gray, SEQ ID NO:8) is a fusion between a crRNA and tracrRNA and comprises a variable targeting domain that is complementary to one DNA strand of the double strand DNA genomic target site. The Cas9 endonuclease is shown in dark gray. Triangles point towards the expected site of DNA cleavage on both sense and anti-sense DNA strands.

FIG. 3A-3B shows an alignment and count of the top 10 most frequent NHEJ mutations induced by the maize optimized guide RNA/Cas endonuclease system described herein compared to a LIG3-4 homing endonuclease control at the maize genomic Liguleless 1 locus. The mutations were identified by deep sequencing. The reference sequence represents the unmodified locus with each target site underlined. The PAM sequence and expected site of cleavage are also indicated. Deletions or insertions as a result of imperfect NHEJ are shown by a "-" or an italicized underlined nucleotide, respectively. The reference and mutations 1-10 of the LIGCas-1 target site correspond to SEQ ID NOs: 55-65, respectively. The reference and mutations 1-10 of the LIGCas-2 correspond to SEQ ID NOs: 55, 65-75, respectively. The reference and mutations 1-10 of the LIGCas-3 correspond to SEQ ID NOs: 76-86, respectively. The reference and mutations 1-10 of the LIG3-4 homing endonuclease target site correspond to SEQ ID NOs: 76, 87-96, respectively.

Figure 4:
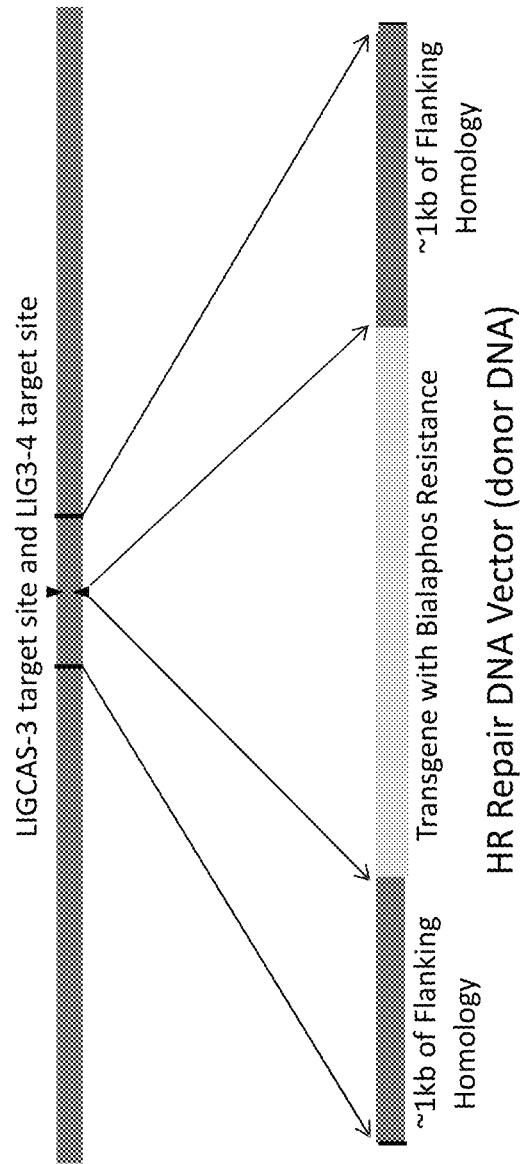

FIG. 4 illustrates how the homologous recombination (HR) repair DNA vector (SEQ ID NO: 97) was constructed. To promote site-specific transgene insertion by homologous recombination, the transgene (shown in light gray) was flanked on either side by approximately 1 kb of DNA with homology to the maize genomic regions immediately adjacent to the LIGCas3 and LIG3-4 homing endonuclease expected sites of cleavage.

Figure 5:
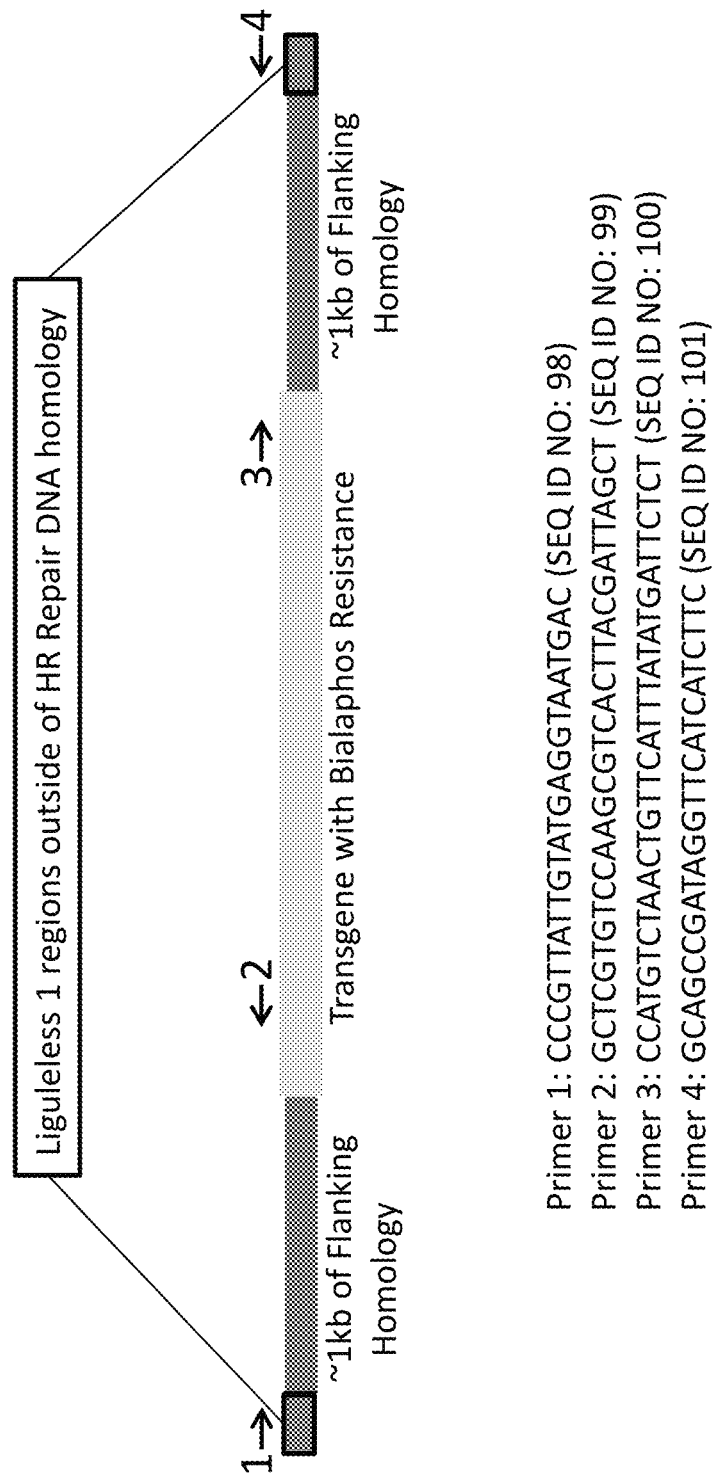

FIG. 5 illustrates how genomic DNA extracted from stable transformants was screened for site-specific transgene insertion by PCR. Genomic primers (corresponding to SEQ ID NOs: 98 and 101) within the Liguleless 1 locus were designed outside of the regions used in constructing the HR repair DNA vector (SEQ ID NO: 97) and were paired with primers inside the transgene (corresponding to SEQ ID NOs: 99 and 100) to facilitate PCR detection of unique genomic DNA junctions created by appropriately oriented site-specific transgene integration.

FIG. 6 shows an alignment of the NHEJ mutations induced by the maize optimized guide RNA/Cas endonuclease system, described herein, when the short guide RNA was delivered directly as RNA. The mutations were identified by deep sequencing. The reference illustrates the unmodified locus with the genomic target site underlined. The PAM sequence and expected site of cleavage are also indicated. Deletions or insertions as a result of imperfect NHEJ are shown by a "-" or an italicized underlined nucleotide, respectively. The reference and mutations 1-6 for 55CasRNA-1 correspond to SEQ ID NOs: 104-110, respectively.

Figure 7:
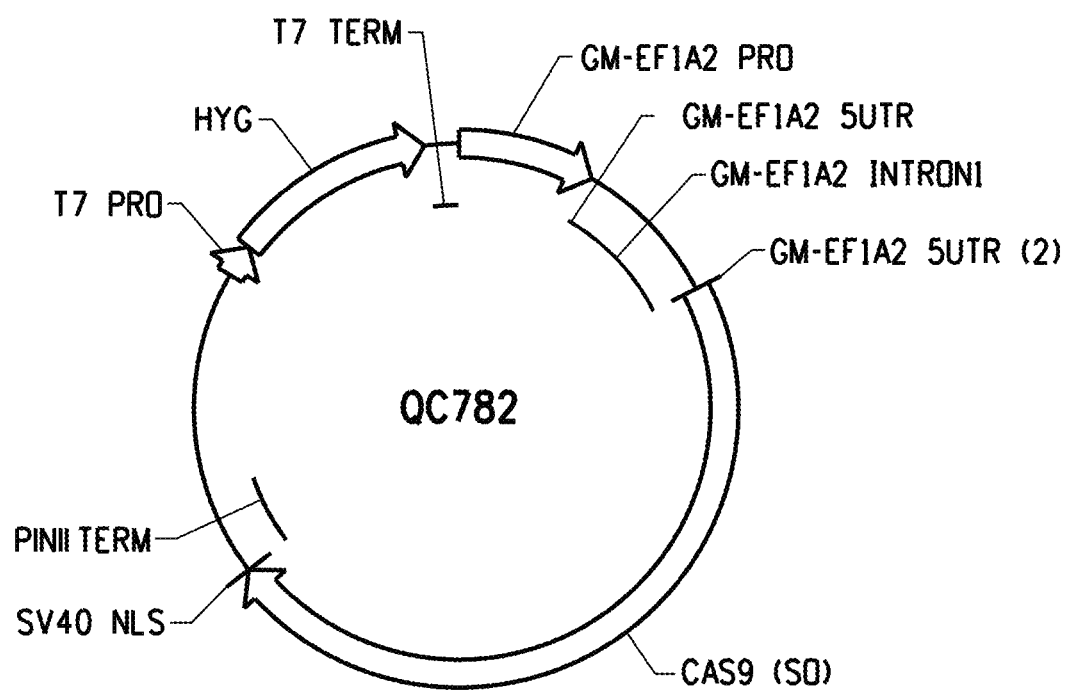

FIG. 7 shows the QC782 vector comprising the Cas9 expression cassette.

Figures 8A, 8B:
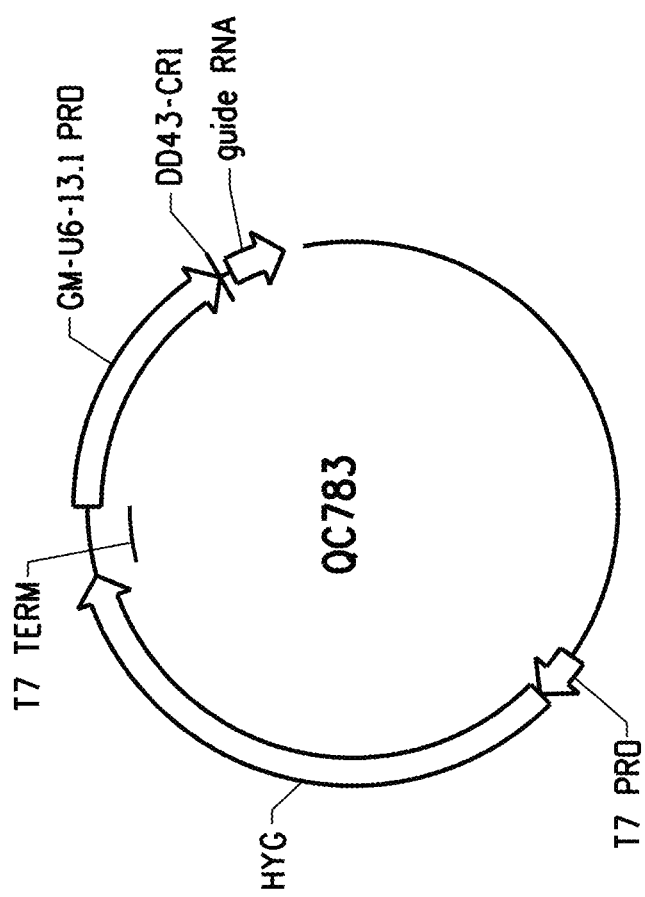
Figure 9:
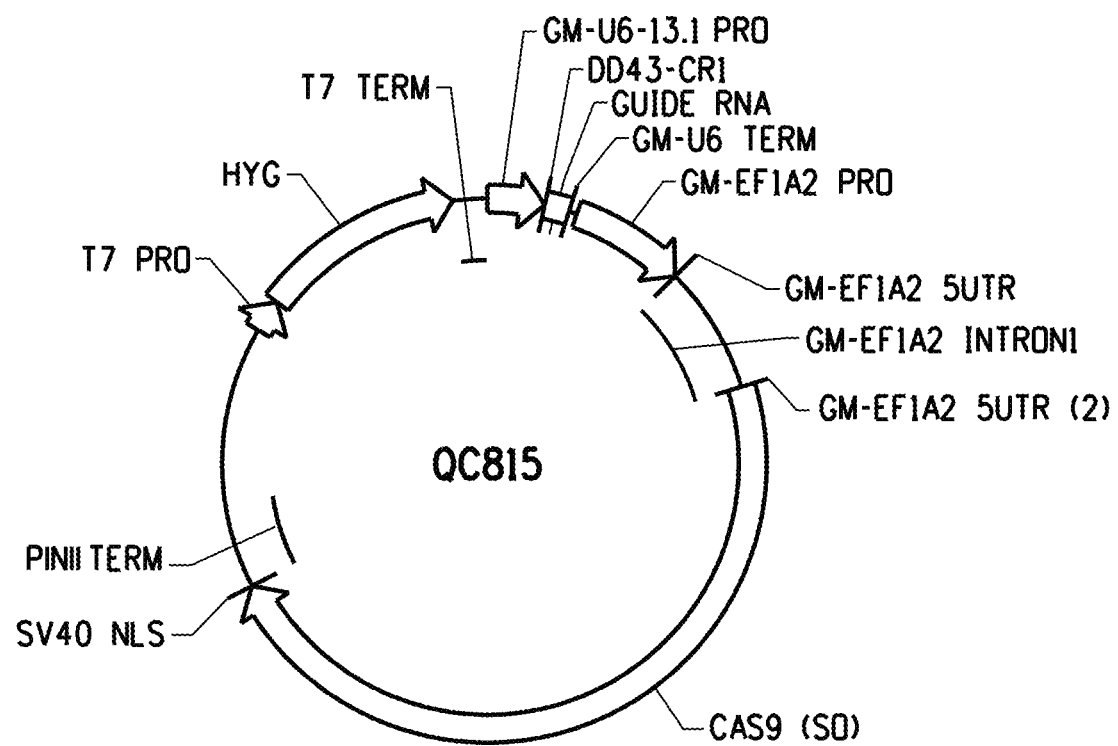

FIG. 8A shows the QC783 vector comprising the guide RNA expression cassette. FIG. 8B show the DNA sequence (coding sequence) of the DD43CR1 (20 bp) variable targeting domain of the guide RNA, as well as the terminator sequence linked to the guide RNA. The 20 bp variable targeting domain DD43CR1 is in bold FIG. 9 shows the map of a linked soybean optimized Cas9 and guide RNA construct QC815.

FIG. 10 A shows the DD20 soybean locus on chromosome 4 and the DD20CR1 and DD20CR2 genomic target sites (indicated by bold arrows). FIG. 10 B shows the DD43 soybean locus on chromosome 4 and the DD43CR1 and DD43CR2 genomic target sites (indicated by bold arrows).

Figures 11A, 11B:
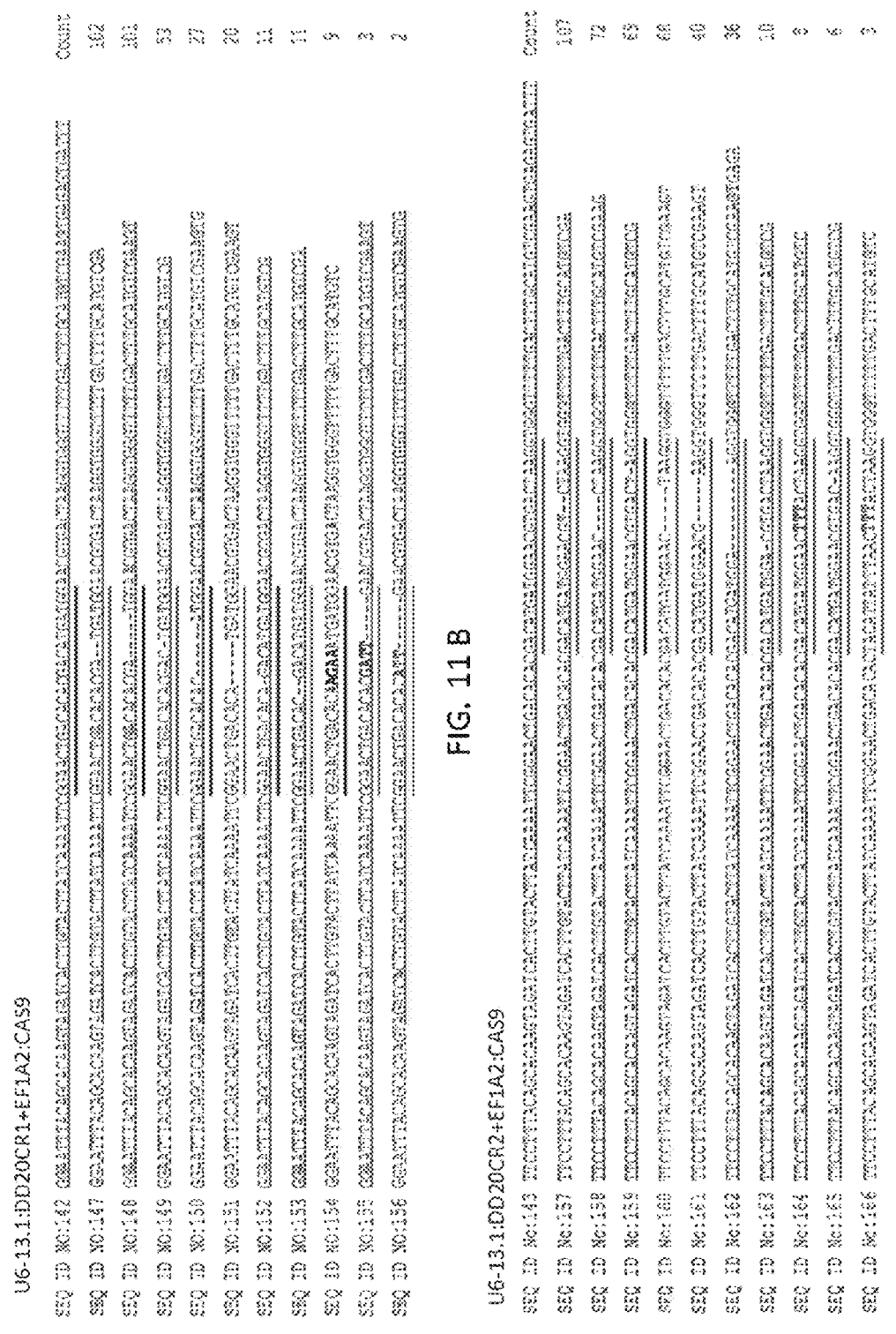
Figures 11C, 11D:
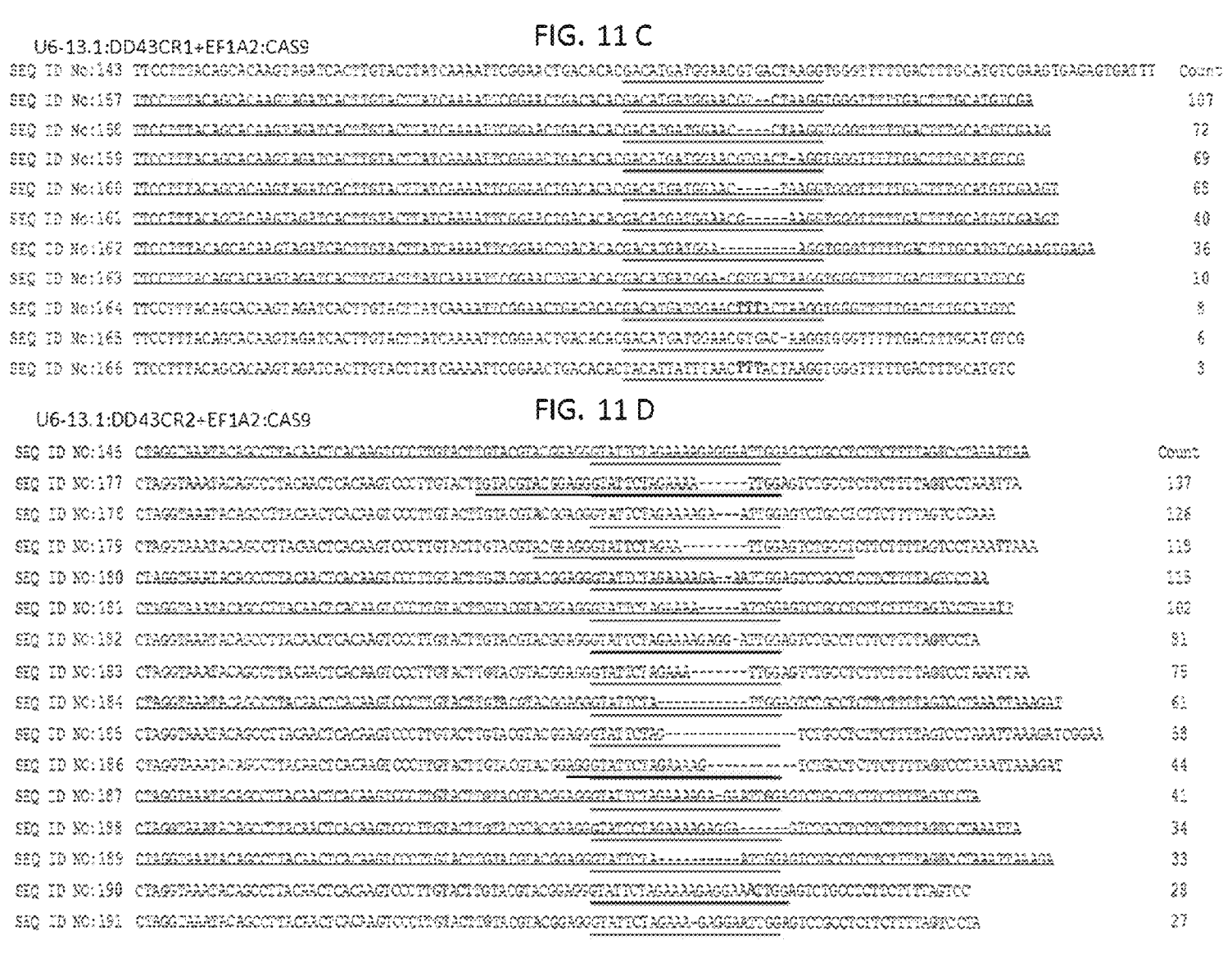

FIG. 11A-11D. Alignments of expected target site sequences with mutant target sequences detected in four guide RNAs induced NHEJ experiments. FIG. 11A shows the DD20CR1 PCR amplicon (reference sequence, SEQ ID NO:142, genomic target site is underlined) and the 10 mutations (SEQ ID NOs: 147-156) induced by the guideRNA/Cas endonuclease system at the DD20CR1 genomic target site. FIG. 11B shows the DD20CR2 PCR amplicon (reference sequence, SEQ ID NO:143) and the 10 mutations (SEQ ID NOs 157-166) induced by the guide RNA/Cas endonuclease system at the DD20CR2 genomic target site. FIG. 11C shows the DD43CR1 PCR amplicon (reference sequence, SEQ ID NO:144) and the 10 mutations (SEQ ID NOs:167-176) induced by the guide RNA/Cas endonuclease system at the DD43CR1 genomic target site. FIG. 11D shows the DD43CR2 PCR amplicon (reference sequence, SEQ ID NO:145) and the 10 mutations (SEQ ID NOs: 177-191) induced by the guide RNA/Cas endonuclease system at the DD43CR2 genomic target site. The target sequences corresponding different guide RNAs are underlined. Each nucleotide deletions is indicated by "-". Inserted and replaced sequences are in bold. The total number of each mutant sequence is listed in the last column.

FIG. 12A-12B shows a schematic representation of the guide RNA/Cas endonuclease system used for editing a nucleotide sequence of interest. To enable specific nucleotide editing, a polynucleotide modification template that includes at least one nucleotide modification (when compared to the nucleotide sequence to be edited) is introduced into a cell together with the guide RNA and Cas endonuclease expression cassettes. For example, as shown herein, the nucleotide sequence to be edited is an endogenous wild type enolpyruvylshikimate-3-phosphate synthase (EPSPS) gene in maize cells. The Cas endonuclease (shaded circle) is a maize optimized Cas9 endonuclease that cleaves a moCas9 target sequence within the epsps genomic locus using a guide RNA of SEQ ID NO:194. FIG. 12-A shows a polynucleotide modification template that includes three nucleotide modifications (when compared to the wild type epsps locus depicted in FIG. 12-B) flanked by two homology regions HR-1 and HR-2. FIG. 12-B shows the guide RNA/ maize optimized Cas9 endonuclease complex interacting with the epsps locus. The original nucleotide codons of the EPSPS gene that needed to be edited are show as aCT and Cca (FIG. 12-B). The nucleotide codons with modified nucleotides (shown in capitals) are shown as aTC and Tca (FIG. 12-B).

Figure 13:
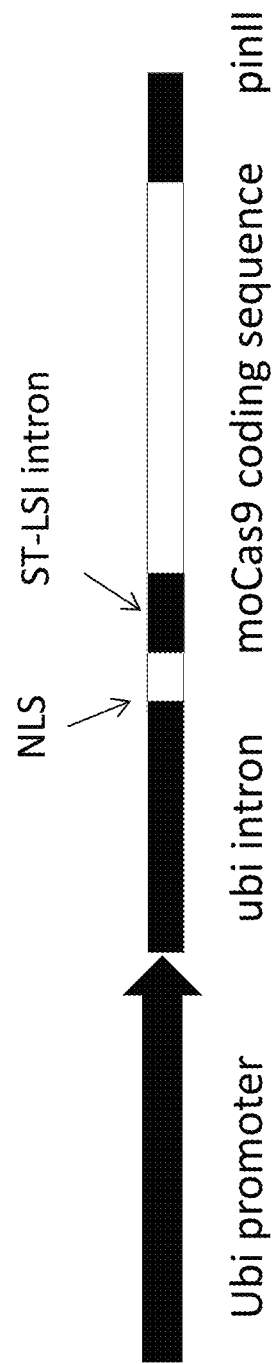

FIG. 13 shows a diagram of a maize optimized Cas9 endonuclease expression cassette. The bacterial cas9 coding sequence was codon optimized for expression in maize cells and supplemented with the ST-LS1 potato intron (moCas9 coding sequence, SEQ ID NO: 193). A DNA fragment encoding the SV40 nuclear localization signal (NLS) was fused to the 5'-end of the moCas9 coding sequence. A maize ubiquitin promoter (Ubi promoter) and its cognate intron (ubi intron) provided controlling elements for the expression of moCas9 in maize cells. The pinII transcription termination sequence (pinII) completed the maize moCAS9 gene design.

Figure 15:
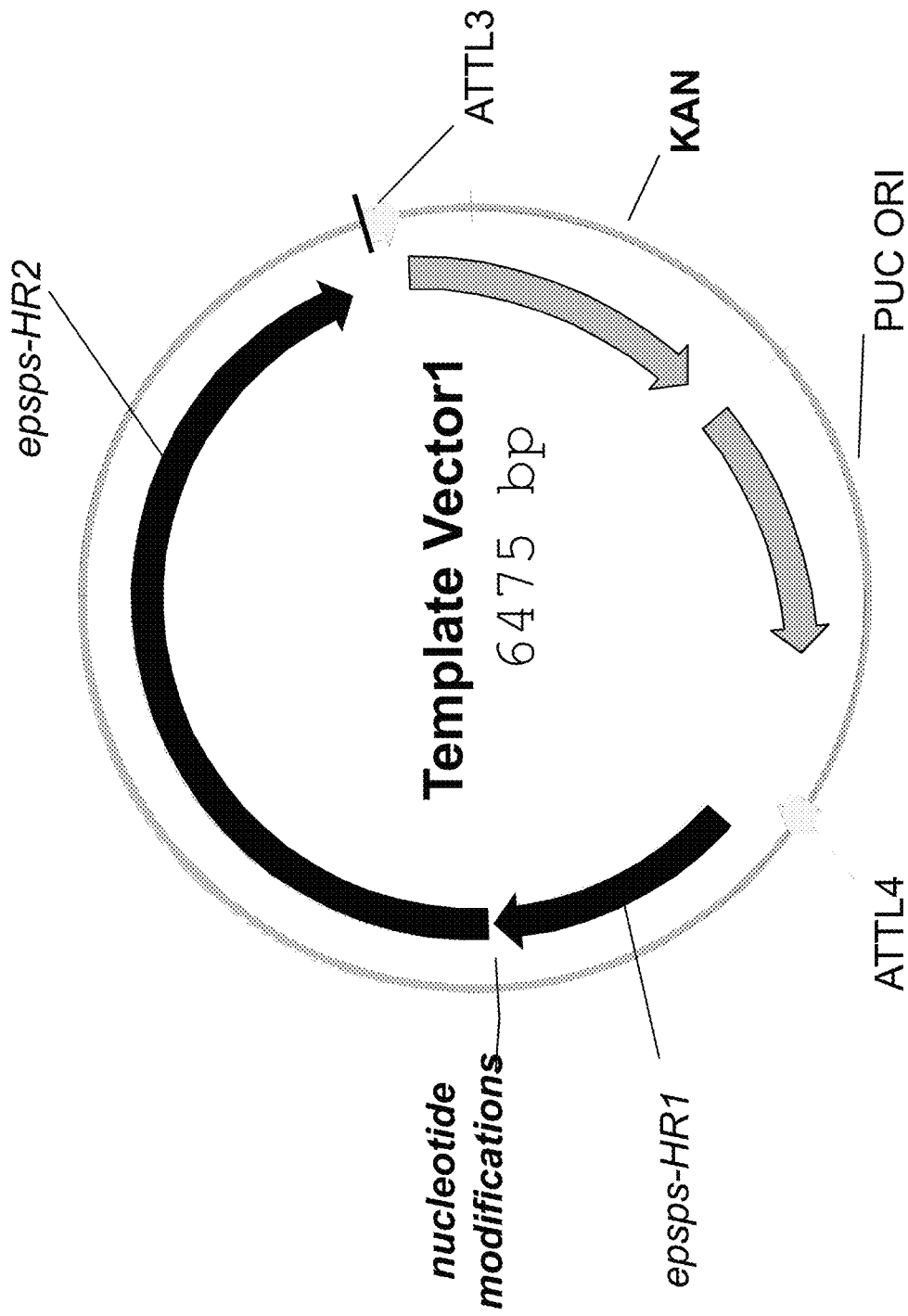

FIG. 14 shows some examples of the moCas9 target sequence (underlined), located on EPSPS DNA fragments, mutagenized by the introduction of double-strand breaks at the cleavage site of the moCas9 endonuclease (thick arrow) in maize cells. In SEQ ID NO: 206, three nucleotides were deleted (dashes) next to the moCas9 cleavage site. SEQ ID NOs: 207-208 indicate that the nucleotide deletion can expand beyond the moCAs9 cleavage site FIG. 15 depicts an EPSPS template vector used for delivery of the EPSPS polynucleotide modification template containing the three TIPS nucleotide modifications. The EPSP polynucleotide modification template includes a partial fragment of the EPSPS gene. The vector was 6,475 bp in length and consisted of two homology regions to the epsps locus (epsps-HR1 and epsps-HR2). Two Gateway cloning sites (ATTL4 and ATTL3), an antibiotic resistance gene (KAN), and the pUC origin of replication (PUC ORI) completed synthesis of the EPSPS template vector1.

FIG. 16 illustrates the PCR-based screening strategy for the identification of maize events with TIPS nucleotide modifications in maize cells. Two pairs of PCR primers were used to amplify the genomic fragments of the epsps locus (upper section). Both of them contained the TIPS specific primers (an arrow with a dot indicating the site of the three TIPS modifications). The shorter fragment (780 bp F-E2) was produced by amplification of the EPSPS polynucleotide modification template fragment (template detection). The amplified EPSPS polynucleotide modification template fragment was found in all but 4 analyzed events (panel F-E2). The longer fragment (839 bp H-T) was produced by amplification of the genomic EPSPS sequence providing that the epsps locus contained the three nucleotide modifications responsible for the TIPS modifications. Six events were identified as containing the three nucleotide modifications (panel H-T). The white arrows point to events that contain both the amplified EPSPS polynucleotide modification template and the nucleotide modifications responsible for the TIPS modification.

Figure 17A:
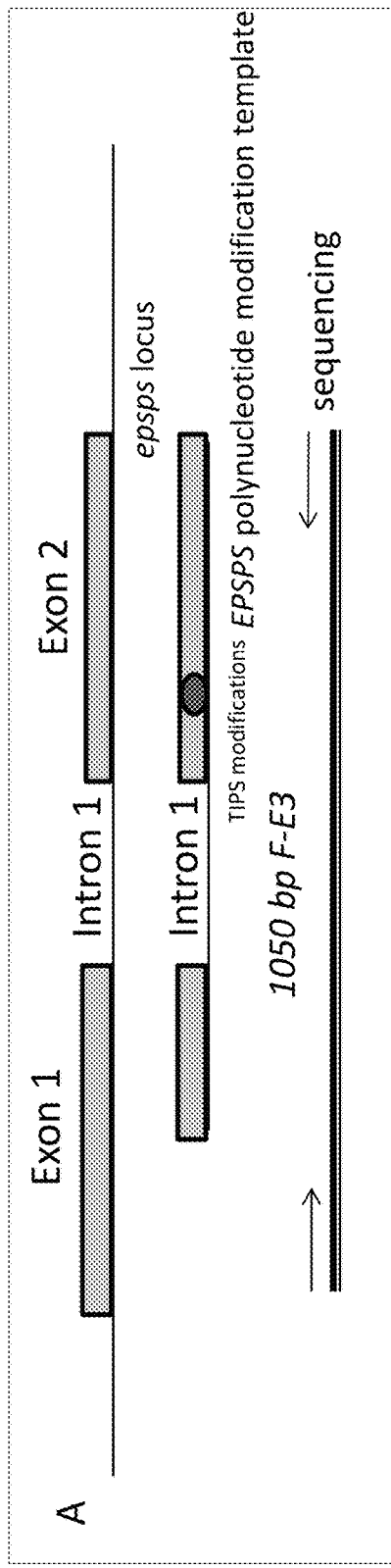
Figure 17B:
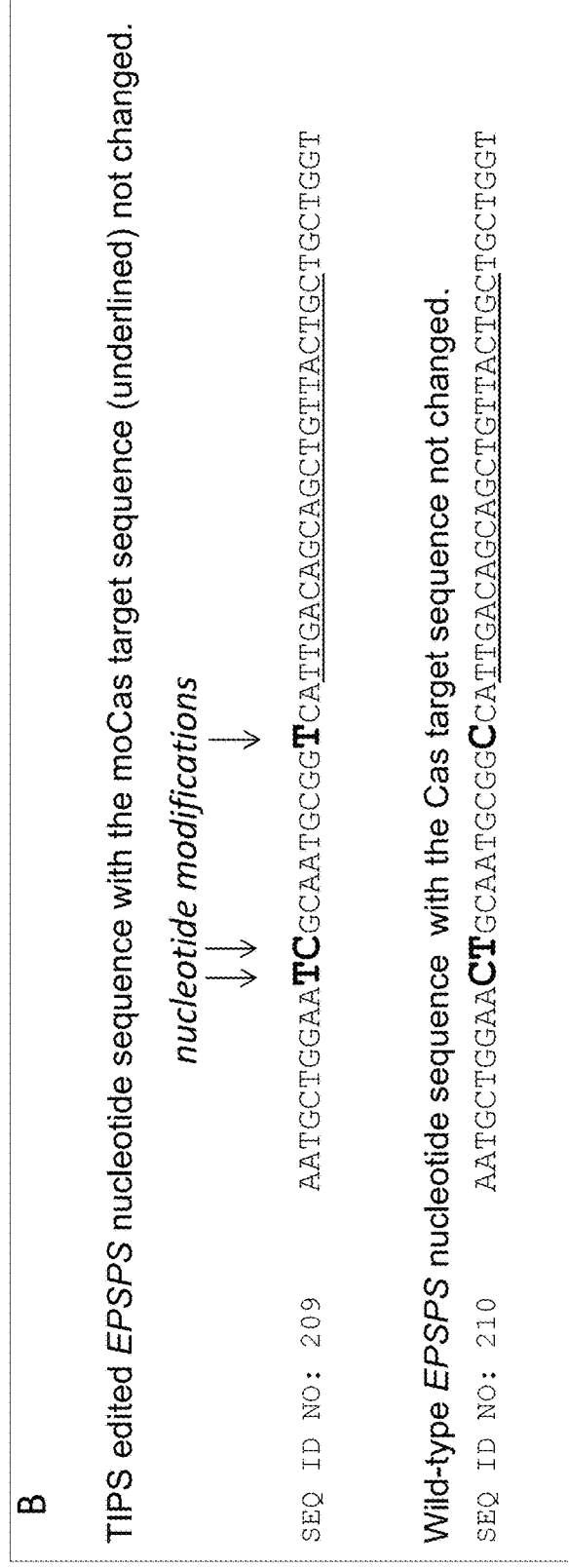

FIG. 17 A shows a schematic diagram of the PCR protocol used to identify edited EPSPS DNA fragments in selected events. A partial genomic fragment, comprising parts of Exon1, Intron 1 and Exon2 of the epsps locus, was amplified regardless of the editing product (panel A, 1050 bp F-E3). The amplification products, representing only partial EPSPS gene sequences having one or more mutations, were cloned and sequenced. FIG. 17-B shows 2 examples of sequenced amplification products. In some amplification products, the epsps nucleotides and the moCas9 target sequence (underlined) were unchanged indicating that one EPSPS allele was not edited (wild type allele; SEQ ID NO: 210). In other amplification products, three specific nucleotide substitutions (representing the TIPS modifications) were identified with no mutations at the moCas9 target sequence (underlined) (SEQ ID NO: 209).

Figure 18:
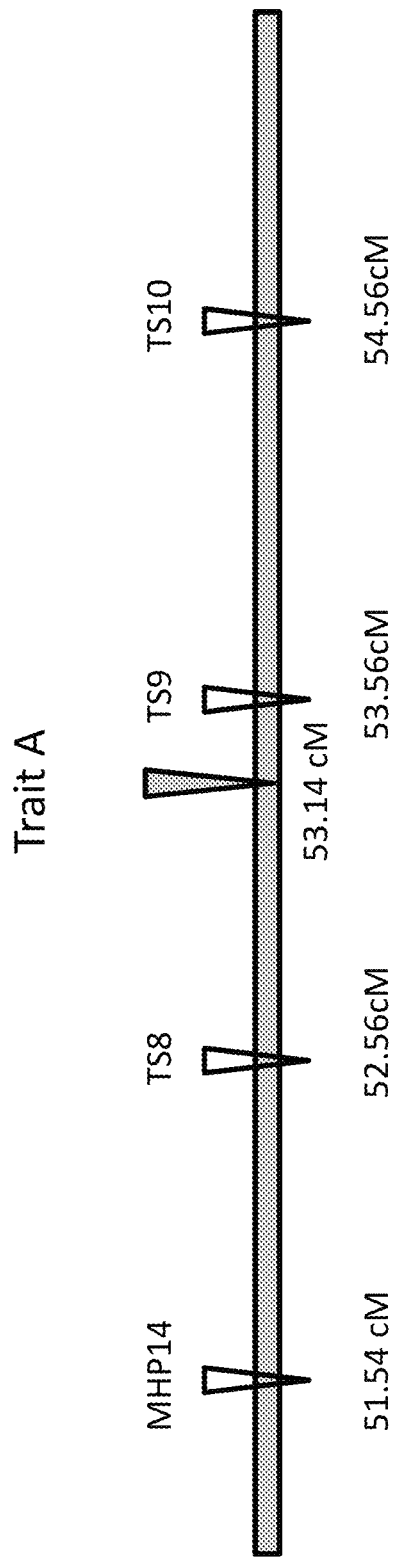

FIG. 18 shows the location of MHP14, TS8, TS9 and TS10 loci comprising target sites for the guide RNA/Cas endonuclease system near trait A (located at 53.14 cM) on chromosome 1 of maize.

FIG. 19A shows the location of the MHP14Cas1 maize genomic target sequence (SEQ ID NO: 229) and the MSP14Cas-3 maize genomic target sequence (SEQ ID NO: 230) on the MHP14 maize genomic DNA locus on chromosome1. The 5' to 3' sequence. FIG. 19B shows the location of the TS8Cas-1 (SEQ ID NO: 231) and TS8Cas-2 (SEQ ID NO: 232) maize genomic target sequences located on the TS8 locus. FIG. 19-C shows the location of the TS9Cas-2 (SEQ ID NO: 233) and TS9Cas-3 (SEQ ID NO: 234) maize genomic target sequences located on the TS8 locus. FIG. 19-D shows the location of the TS10Cas-1 (SEQ ID NO: 235), and TS10Cas-3 (SEQ ID NO: 236) maize genomic target sequences located on the TS10 locus. All these maize genomic target sites are recognized are recognized and cleaved by a guide RNA/Cas endonuclease system described herein. Each maize genomic target sequence (indicated by an arrow) is highlighted in bold and followed by the NGG PAM sequence shown boxed in.

Figure 20:
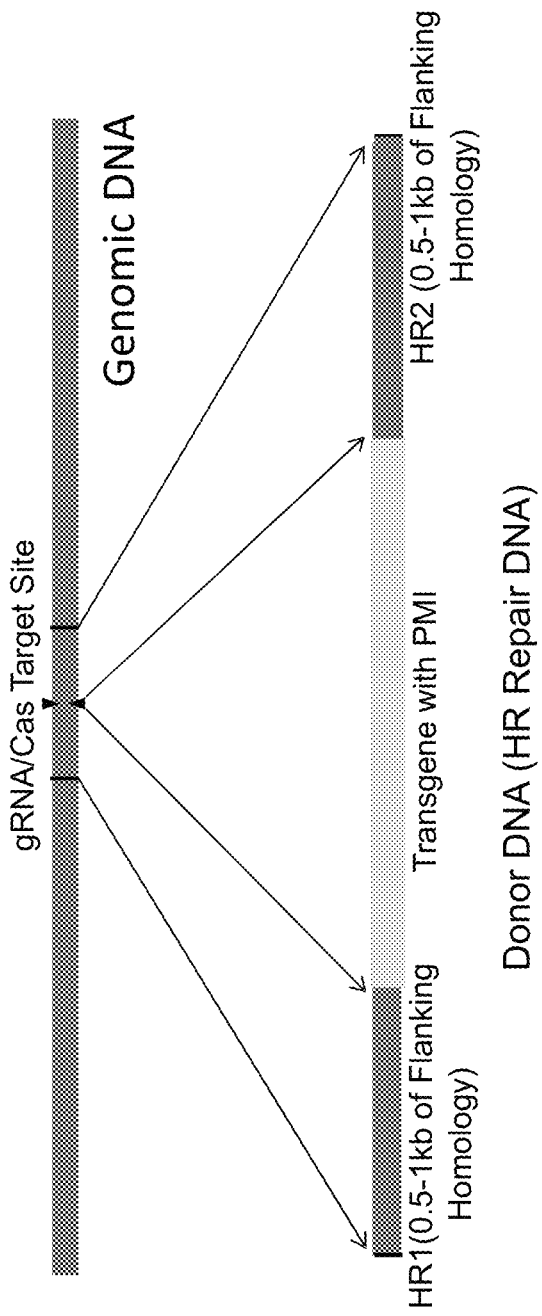

FIG. 20 shows a schematic of a donor DNA (also referred to as HR repair DNA) comprising a transgene cassette with a selectable marker (phosphomannose isomerase, depicted in grey), flanked by homologous recombination sequences (HR1 and HR2) of about 0.5 to 1 kb in length, used to introduce the transgene cassette into a genomic target site for the guide RNA/Cas endonuclease system. The arrows indicate the sections of the genomic DNA sequence on either side of the endonuclease cleavage site that corresponds to the homologous regions of the donor DNA. This schematic is representative for homologous recombination occurring at any one of the 8 target sites (4 loci) located on chromosome 1 from 51.54 cM to 54.56 cM in maize genome.

Figure 21:
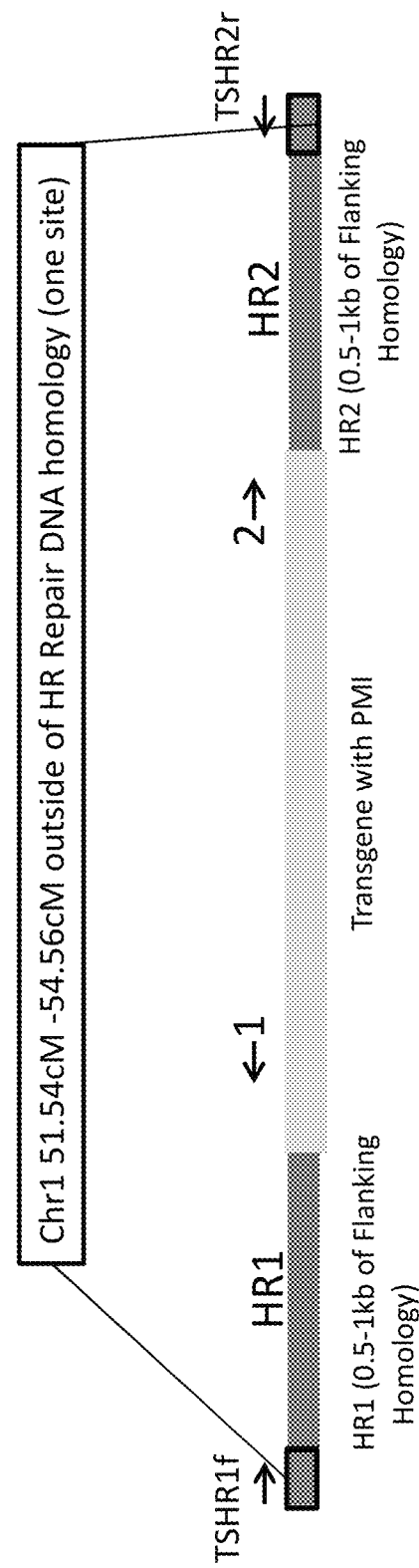

FIG. 21 shows the junction PCR screen for identification of insertion events. Primer 1 and 2 located on the transgene donor are common for all target sites. Primer TSHR1f is located on the genomic region outside of the homologous sequence HR1. Primer combination THR1f/primer1 amplify junction 1. Primer TSHR2r is located on the genomic region outside of the HR2 region. Primer combination primer2/TSHR2r amplify junction 2.

Figure 22:
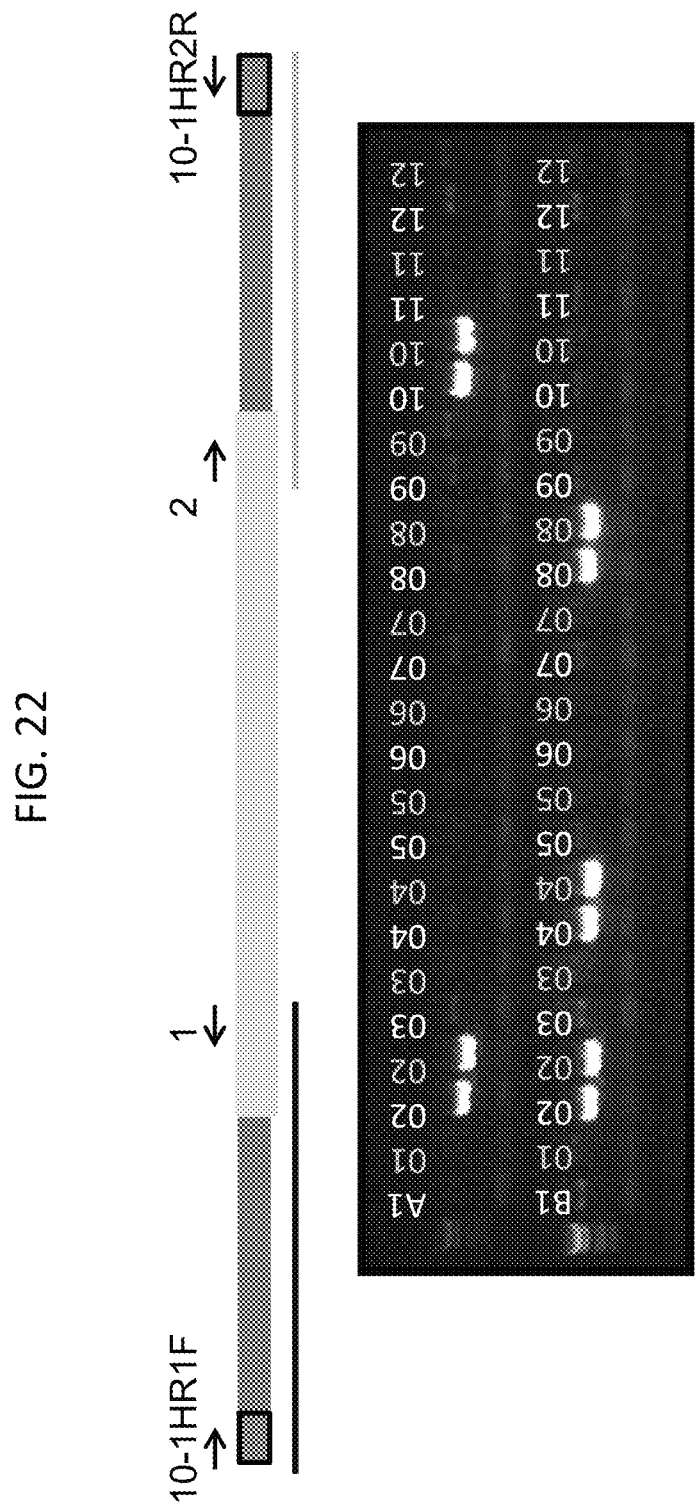

FIG. 22 shows a junction PCR screen for identification of insertion events at the TS10Cas10 locus. A gel picture indicates the presence of insertion events at the TS10Cas10-1 target site (lane 02 A1). PCR reaction of HR1 and HR2 junction loaded next to each other (lane 02-white label and lane 02-gray label), with white label representing HR1 junction PCR, gray label representing HR2 junction PCR.

FIG. 23 A-B. DNA expression cassettes used in gRNA/Cas9 mediated genome modification experiments. A) The Cas9 endonuclease cassette (EF1A2:CAS9) comprising a soybean EF1A2 promoter (GM-EF1A2 PRO) driving the soybean codon optimized Cas9 endonucleases (CAS9(SO)), a soybean optimized SV40 nuclear localization signal (SV40 NLS(SO)) and a PINII terminator (PINII TERM) was linked to a guide RNA expression cassette (U6-9.1:DD20CR1, comprising a soybean U6 promoter driving the DD20CR1 guide RNA) used in experiment U6-9.1 DD20CR1 (Table 27). Other Guide RNA/Cas9 cassettes listed in Table 27 are identical except for the 20 bp variable targeting domains of the guide RNA targeting the genomic target sites DD20CR2, DD43CR1, or DD43CR2. B) The donor DNA cassette (DD20HR1-SAMS:HPT-DD20HR2) used in experiment U6-9.1 DD20CR1 (Table 27). DD20HR1 and DD20HR2 homologous DNA regions between the donor DNA cassette and the genomic DNA sequences flanking the DD20 target site). Other Donor DNA cassettes listed in Table 27 are identical except for the DD43HR1 and DD43HR2 regions in two of them.

FIG. 24 A-C. DD20 and DD43 soybean genomic target sites locations and qPCR amplicons. A) Diagram of *Glycine max* chromosome 04 indicating relative positions of DD20 and DD43 target sites. Genetic mapping positions of DD20 and DD43 sites are the positions of the most nearby genes Glyma04g39780.1 and Glyma04 g39550.1. B) DD20 qPCR 64 bp amplicon 45936307-45936370 from chromosome 04 (SEQ ID NO: 304). Relative positions of the target sites DD20-CR1 and DD20-CR2, qPCR primers and probe DD20-F, DD20-R, and DD20-T are marked. C) DD43 qPCR 115 bp amplicon 45731879-45731993 from chromosome 04 (SEQ ID NO: 305). Relative positions of the target sites DD43-CR1 and DD43-CR2, qPCR primers and probe DD43-F2, DD43-F, DD43-R, and DD43-T are marked.

FIG. 25 A-C. Schematic of guide RNA/Cas9 system mediated site-specific non-homologous end joining (NHEJ) and transgene insertion via homologous recombination (HR) at DD20CR1 site. A) Soybean plants are co-transformed with guide RNA/Cas9 and donor DNA cassettes as listed in Table 27. The DD20CR1 guide RNA/Cas9 complex transcribed from the linked guide RNA/Cas9 DNA cassettes will cleave specifically the DD20CR1 target site on chromosome 04 to make DNA double strand breaks. The breaks can be repaired spontaneously as NHEJs or repaired as a HR event by the donor DNA facilitated by the flanking homologous regions DD20-HR1 and DD20HR2. B) NHEJs are detected by DD20-specific qPCR and the mutated sequences are assessed by sequencing cloned HR1-HR2 PCR fragments. C) HR events are revealed by two border-specific PCR analyses HR1-SAMS and NOS-HR2, noting that the primers are only able to amplify DNA recombined between the DD20CR1 region of chromosome 04 and the donor DNA. Guide RNA/Cas9 mediated NHEJ and HR at DD20-CR2 site follow the same process except for using DD20-CR2 guide RNA. Guide RNA/Cas9 mediated site-specific NHEJ and HR at DD43CR1 and DD43CR2 sites follow the same process except for using guide RNA and homologous regions specific to the DD43 sites.

FIG. 26 A-C. Sequences of gRNA/Cas9 system mediated NHEJs. Only 60 bp sequences surrounding the genomic target site shown in bold case are aligned to show the mutations. The PAM sequence is shown boxed in. Insertion sequences are indicated by symbol ^marking the insertion position followed by the size of the insert. Actual insertion sequences are listed in the sequences listing. A) U6-9.1 DD20CR1 sequences. Three colonies were sequenced for each of 54 events from experiment U6-9.1 DD20CR1. A total of 150 sequences were returned, of which 26 were found to be short unique deletions while 2 of the events contained small insertions. B) U6-9.1 DD20CR2 sequences. Three colonies were sequenced for each of 28 events from experiment U6-9.1 DD20CR2. A total of 84 sequences were returned, of which 20 were found to be short unique deletions while 1 of the events contained a single bp insertion. C) U6-9.1 DD43CR1 sequences. Three colonies were sequenced for each of 46 events from experiment U6-9.1 DD43CR1. A total of 132 sequences were returned, of which 18 were found to be short unique deletions while 10 of the events contained small insertions. D) U6-9.1 DD43CR2 sequences.

Figure 27B:
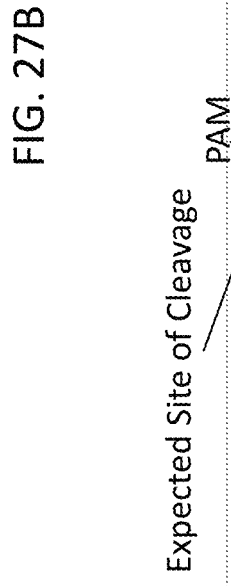

FIG. 27 A-C shows the ten most prevalent types of NHEJ mutations recovered based on the crRNA/tracrRNA/Cas endonuclease system. FIG. 27A shows NHEJ mutations for LIGCas-1 target site, corresponding to SEQ ID NOs: 415-424), FIG. 27B shows NHEJ mutations for LIGCas-2 target site corresponding to SEQ ID NOs: 425-434) and FIG. 27C shows NHEJ mutations (for LIGCas-3 target site corresponding to SEQ ID NOs: 435-444).

Figure 28:
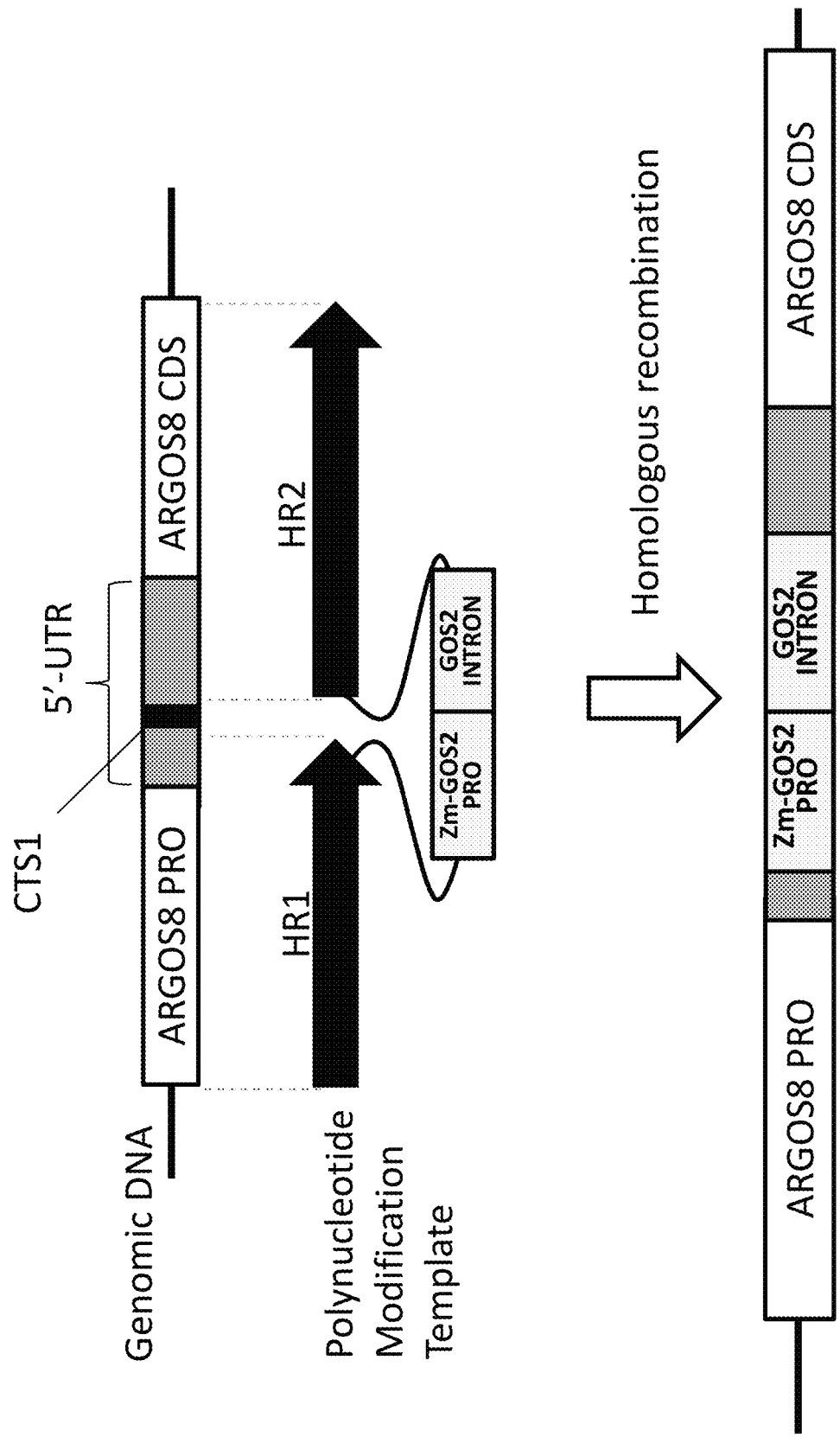

FIG. 28. Schematic representation of Zm-GOS2 PRO: GOS2 INTRON insertion in the 5'-UTR of maize ARGOS8 gene by targeting the guide RNA/Cas9 target sequence 1 (CTS1, SEQ ID NO: 1) with the gRNA1/Cas9 endonuclease system, described herein. HR1 and HR2 indicate homologous recombination regions.

FIG. 29A-29C. Identification and analysis of Zm-GOS2 PRO:GOS2 INTRON insertion events in maize plants. (A) Schematic representation of Zm-GOS2 PRO:GOS2 INTRON insertion in the 5'-UTR of Zm-ARGOS8. CTS1 was targeted with the gRNA1/Cas9 endonuclease system, described herein. HR1 and HR2 indicate homologous recombination regions. P1 to P4 indicate PCR primers. (B) PCR screening of PMI-resistance calli to identify insertion events. PCR results are shown for 13 representative calli. The left and right junction PCRs were carried out with the primer pair P1+P2 and P3+P4, respectively. (C) PCR analysis of a T0 plant. A PCR product with the expected size (2.4 kb, Lane T0) was amplified with the primer P3 and P4.

Figure 30:
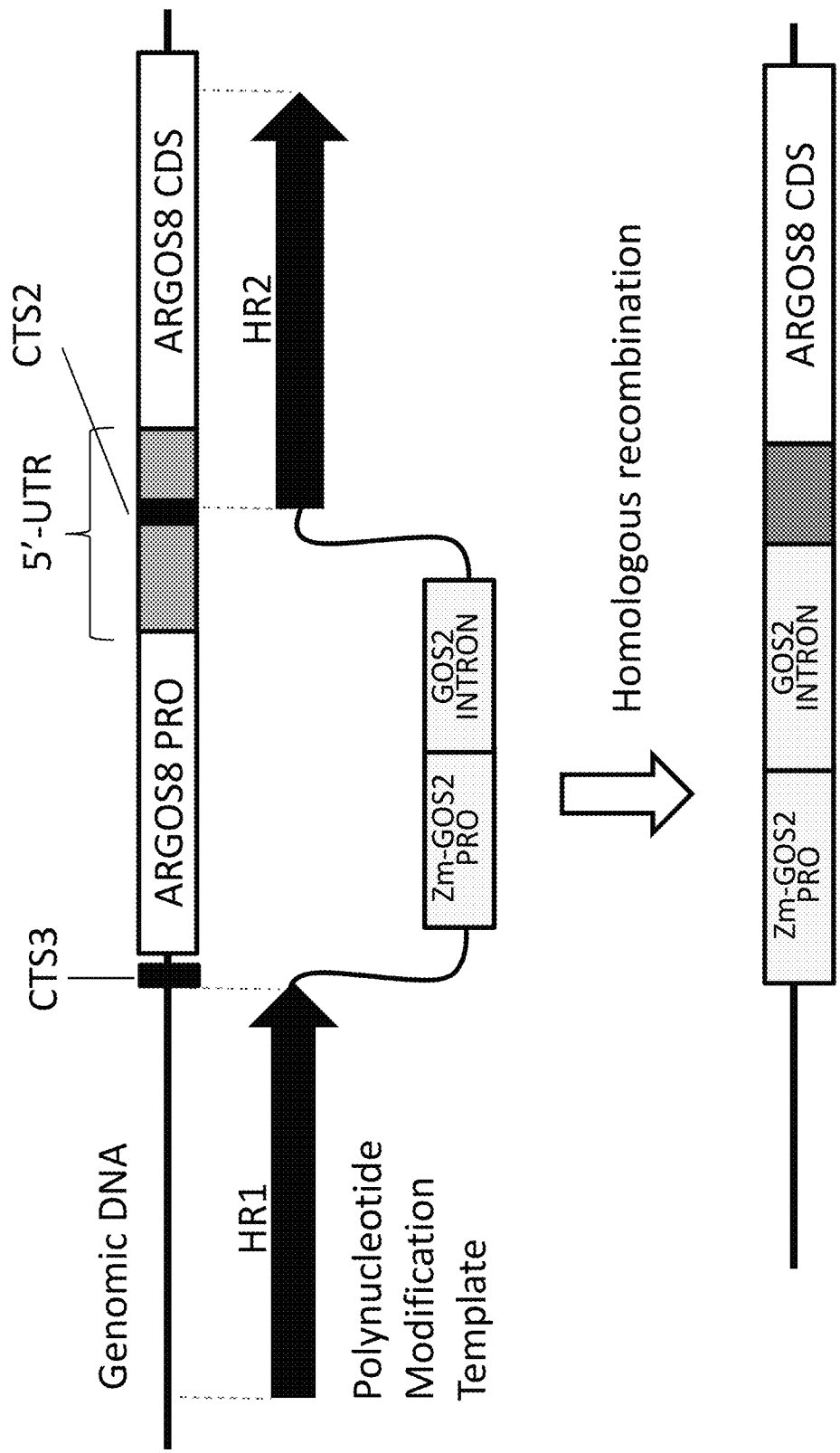

FIG. 30. Schematic representation of Zm-ARGOS8 promoter substitution with Zm-GOS2 PRO:GOS2 INTRON by targeting CTS3 (SEQ ID NO: 3) and CTS2 (SEQ ID NO:2). HR1 and HR2 indicate homologous recombination regions.

FIG. 31A-31D. Substitution of the native promoter of the ARGOS8 gene with Zm-GOS2 PRO:GOS2 INTRON in maize plants. (A) Schematic representation of the Zm-GOS2 PRO:GOS2 INTRON:ARGOS8 allele generated by promoter swap. Two guide RNA/Cas9 target sites, CTS3 (SEQ ID NO:3) and CTS2 (SEQ ID NO:2), were targeted with a gRNA3/gRNA2/Cas9 system. HR1 and HR2 indicate homologous recombination regions. P1 to P5 indicate PCR primers. (B) PCR screening of PMI-resistance calli to identify swap events. PCR results are shown for 10 representative calli. One callus sample, 12A09, is positive for both left junction (L, primer P1+P2) and right junction (R, primer P5+P4) PCR, indicating that 12A09 is a swap event. (C) PCR analysis of the callus events identified in primary screening. PCR products with the expected size (2.4 kb) were amplified using the primer P3 and P4 from event #3, 4, 6, 8 and 9, indicating presence of the Zm-GOS2 PRO: GOS2 INTRON:ARGOS8 allele. (D) PCR analysis of a T0 plant. A PCR product with the expected size (2.4 kb, Lane T0) was amplified with the primer P3 and P4.

FIG. 32A-32B. Deletion of the native promoter of the ARGOS8 gene in maize plants. (A) Schematic representation of promoter deletion. Two guide RNA's and a Cas9 endonuclease system, referred to as a gRNA3/gRNA2/Cas9 system, were used to target the CTS3 and CTS2 sites in Zm-ARGOS8. P1 and P4 indicate PCR primers for deletion event screening. (B) PCR screening of PMI-resistance calli to identify deletion events. PCR results are shown for 15 representative calli. A 1.1-kp PCR product indicates deletion of the CTS3/CTS2 fragment.

FIG. 33. Schematic representation of enhancer element deletions using the guide RNA/Cas9 target sequence. The enhancer element to be deleted can be, but is not limited to, a 35S enhancer element.

FIG. 34A-34C. Modification of a maize EPSPS polyubiquitination site. (A) The selected maize EPSPS polyubiquitination site is compared to the analogous sites of other plant species. (B) The nucleotides to be edited in the maize EPSPS coding sequence (underlined, encoded amino acid shown in bold). (C) The edited EPSPS coding sequence identified in the selected T0 plant.

FIG. 35A-35C. The intron mediated enhanced element (A). The 5' section of the first intron of the EPSPS gene (editing: substitutions underlined and deletions represented by dots) (B) and its edited version conferring three IMEs elements (underlined). The edited nucleotides are shown in bold (C).

Figure 36:
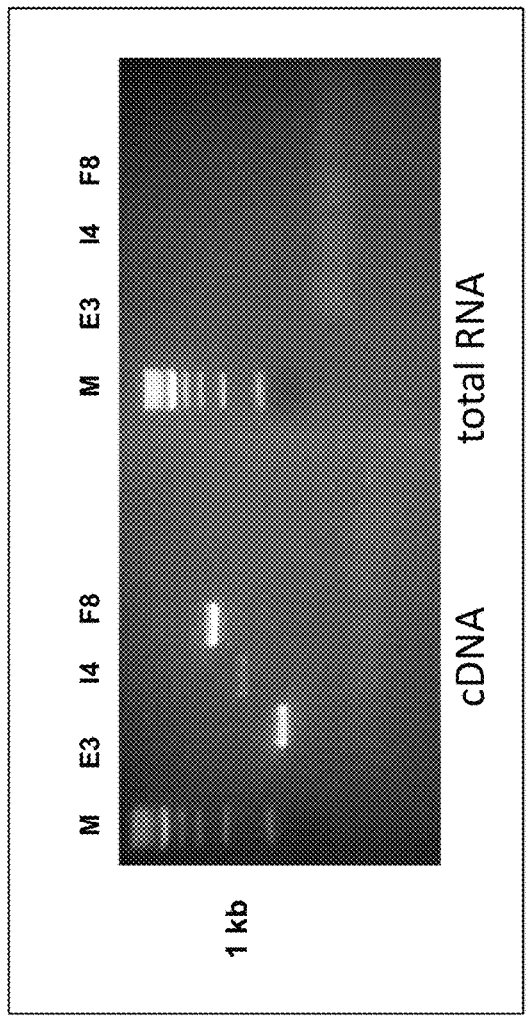
Figure 36:
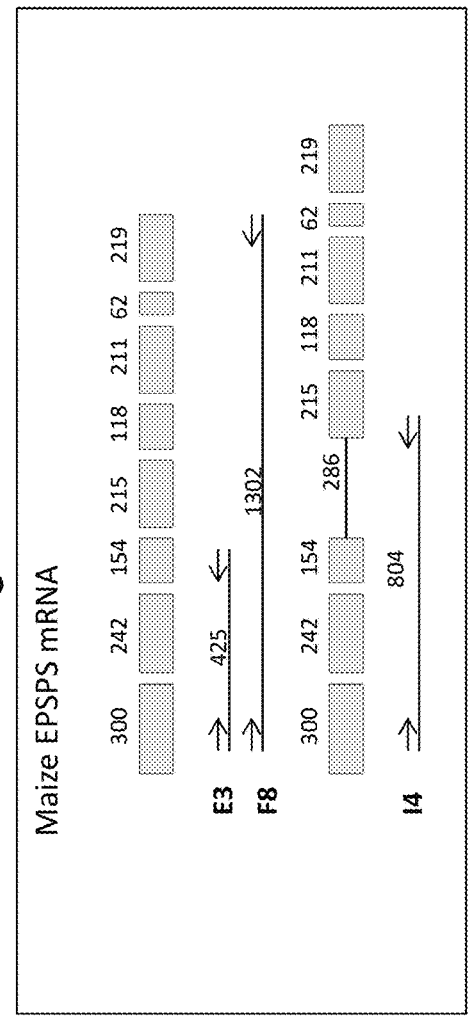

FIG. 36A-36B. Alternatively spliced EPSPS mRNA in maize cells. (A) left panel represents analysis of EPSPS cDNA. The lane I4 in FIG. 36A shows amplification of the EPSPS pre-mRNA containing the $3^{rd}$ intron unspliced (the 804 bp diagnostic fragment as shown in FIG. 36 B indicates an alternate splicing event). Lanes E3 and F8 show the EPSPS PCR amplified fragments with spliced introns. These diagnostic fragments are not amplified unless cDNA is synthesized (as is evident by the absence of bands in lanes E3, I4, and F8 comprising total RNA (shown in the total RNA panel on right of FIG. 36A). The grey boxes in FIG. 36 B represent the eight EPSPS exons (their sizes are indicated above each of them).

Figure 37:
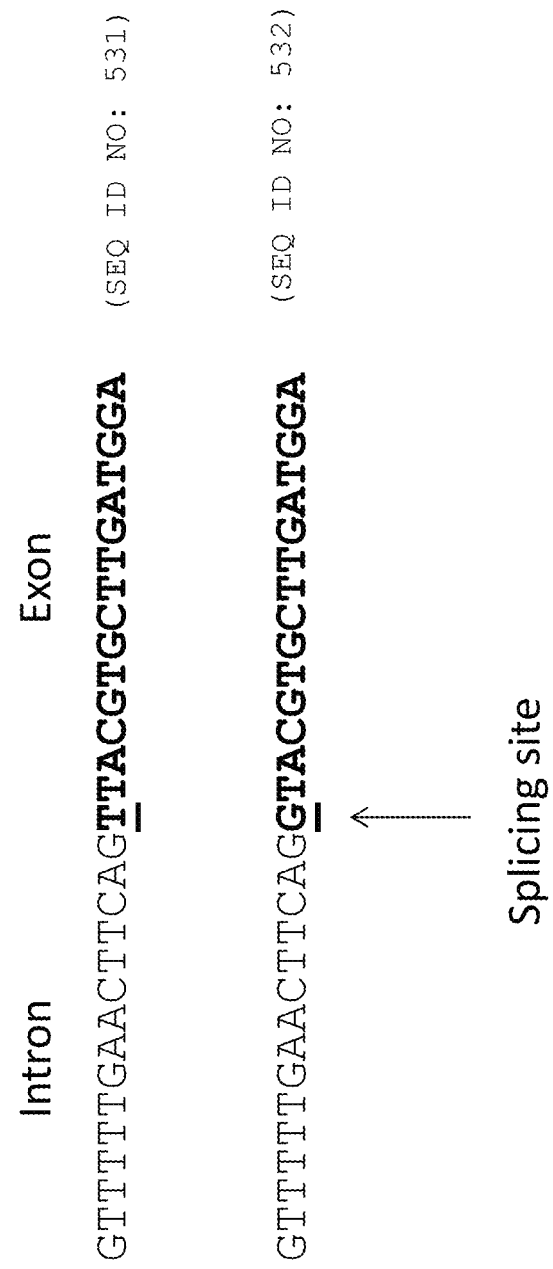

FIG. 37. Splicing site at the junction between the second EPSPS intron and the third exon (bolded). The nucleotide to be edited is underlined.

Figure 38:
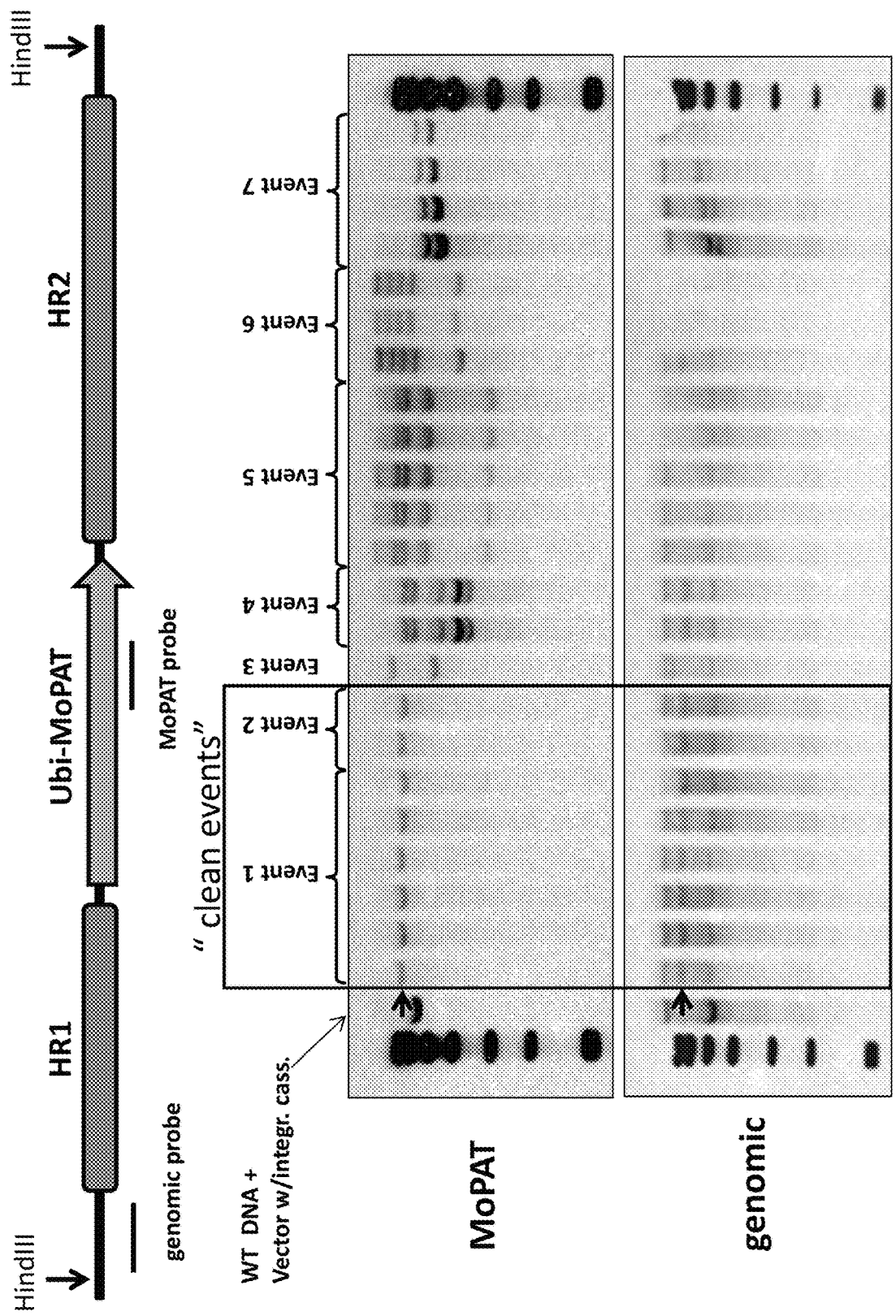

FIG. 38. Schematic representation of Southern hybridization analysis of T0 and T1 plants.

Figure 39:
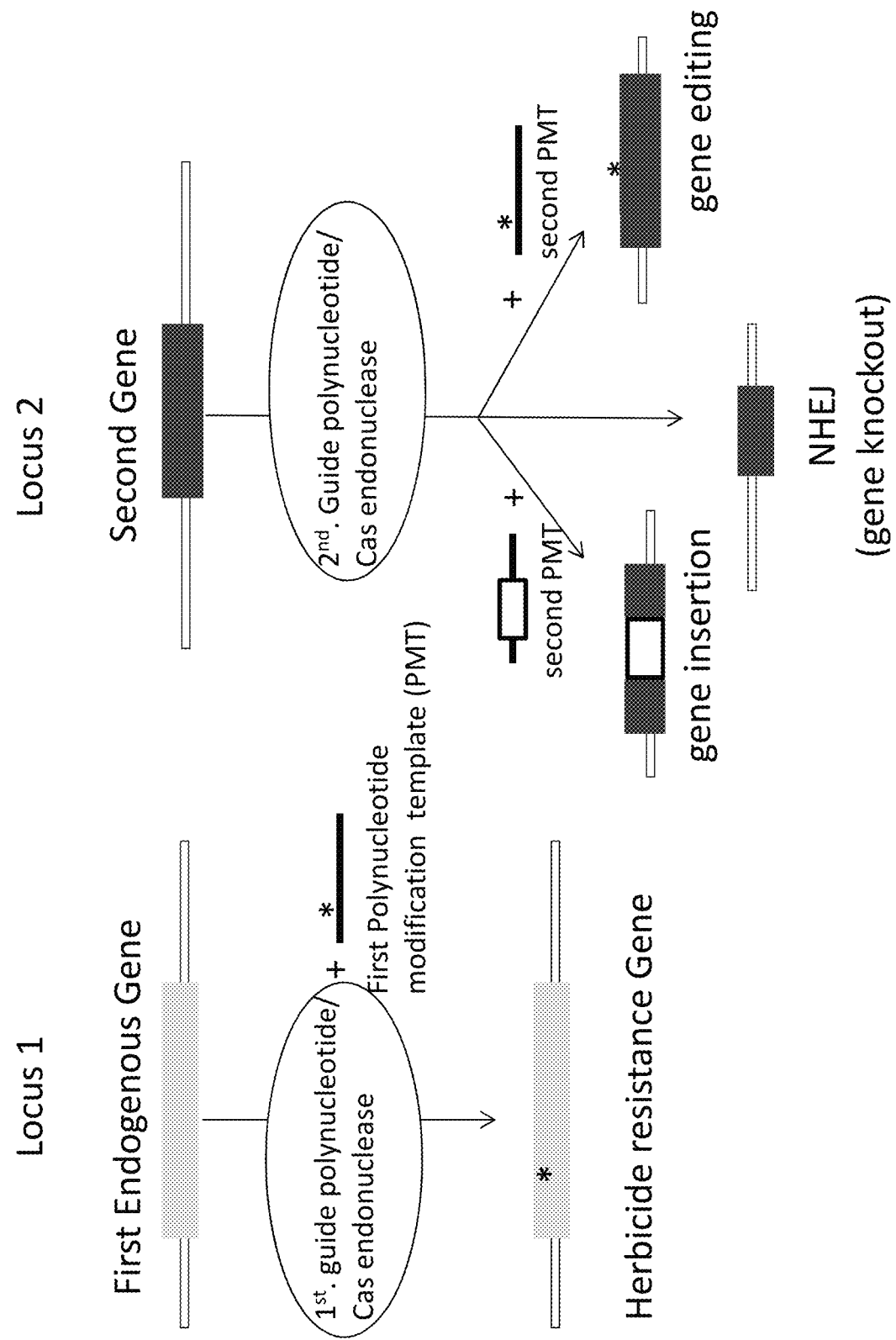

FIG. 39. Schematic representation of methods for producing a genetic modification (a gene insertion, a gene knockout via non-homologous-end-joining (NHEJ), a gene editing, or any combination thereof) into a second gene of a plant genome without introducing an exogenous selectable marker into said plant genome. A first endogenous gene (located in a first locus-locus 1) can be modified to confer herbicide resistance using a first guide polynucleotide/Cas endonuclease system together with a first polynucleotide modification template. At the same time, a second guide polynucleotide/Cas endonuclease system is provided to the same cell, with or without a second polynucleotide modification template to enable the second guide polynucleotide/Cas endonuclease system to introduce a double strand break at a second target site in the genome of said plant cell, resulting in either a gene insertion, gene knockout (NHEJ) or a gene editing. The second gene can be located at different locus (say locus 2) than the first endogenous gene. A "*" represents at least one nucleotide alteration in the polynucleotide modification template (PMT). A second PMT can comprise a polynucleotide of interest (shown by a white box) for gene insertion.

SEQUENCES

SEQ ID NO: 1 is the nucleotide sequence of the Cas9 gene from *Streptococcus pyogenes* M1 GAS (SF370).

SEQ ID NO: 2 is the nucleotide sequence of the potato ST-LS1 intron.

SEQ ID NO: 3 is the amino acid sequence of SV40 amino N-terminal.

SEQ ID NO: 4 is the amino acid sequence of *Agrobacterium tumefaciens* bipartite VirD2 T-DNA border endonuclease carboxyl terminal.

SEQ ID NO: 5 is the nucleotide sequence of an expression cassette expressing the maize optimized Cas9.

SEQ ID NO: 6 is the nucleotide sequence of crRNA containing the LIGCas-3 target sequence in the variable targeting domain.

SEQ ID NO: 7 is the nucleotide sequence of the tracrRNA.

SEQ ID NO: 8 is the nucleotide sequence of a long guide RNA containing the LIGCas-3 target sequence in the variable targeting domain.

SEQ ID NO: 9 is the nucleotide sequence of the Chromosome 8 maize U6 polymerase III promoter.

SEQ ID NO: 10 list two copies of the nucleotide sequence of the maize U6 polymerase III terminator.

SEQ ID NO: 11 is the nucleotide sequence of the maize optimized short guide RNA containing the LIGCas-3 variable targeting domain.

SEQ ID NO: 12 is the nucleotide sequence of the maize optimized long guide RNA expression cassette containing the LIGCas-3 variable targeting domain.

SEQ ID NO: 13 is the nucleotide sequence of the Maize genomic target site MS26Cas-1 plus PAM sequence.

SEQ ID NO: 14 is the nucleotide sequence of the Maize genomic target site MS26Cas-2 plus PAM sequence.

SEQ ID NO: 15 is the nucleotide sequence of the Maize genomic target site MS26Cas-3 plus PAM sequence.

SEQ ID NO: 16 is the nucleotide sequence of the Maize genomic target site LIGCas-2 plus PAM sequence.

SEQ ID NO: 17 is the nucleotide sequence of the Maize genomic target site LIGCas-3 plus PAM sequence.

SEQ ID NO: 18 is the nucleotide sequence of the Maize genomic target site LIGCas-4 plus PAM sequence.

SEQ ID NO: 19 is the nucleotide sequence of the Maize genomic target site MS45Cas-1 plus PAM sequence.

SEQ ID NO: 20 is the nucleotide sequence of the Maize genomic target site MS45Cas-2 plus PAM sequence.

SEQ ID NO: 21 is the nucleotide sequence of the Maize genomic target site MS45Cas-3 plus PAM sequence.

SEQ ID NO: 22 is the nucleotide sequence of the Maize genomic target site ALSCas-1 plus PAM sequence.

SEQ ID NO: 23 is the nucleotide sequence of the Maize genomic target site ALSCas-2 plus PAM sequence.

SEQ ID NO: 24 is the nucleotide sequence of the Maize genomic target site ALSCas-3 plus PAM sequence.

SEQ ID NO: 25 is the nucleotide sequence of the Maize genomic target site EPSPSCas-1 plus PAM sequence.

SEQ ID NO: 26 is the nucleotide sequence of the Maize genomic target site EPSPSCas-2 plus PAM sequence.

SEQ ID NO: 27 is the nucleotide sequence of the Maize genomic target site EPSPSCas-3 plus PAM sequence.

SEQ ID NOs: 28-52 are the nucleotide sequence of target site specific forward primers for primary PCR as shown in Table 2.

SEQ ID NO: 53 is the nucleotide sequence of the forward primer for secondary PCR.

SEQ ID NO: 54 is the nucleotide sequence of Reverse primer for secondary PCR

SEQ ID NO: 55 is the nucleotide sequence of the unmodified reference sequence for LIGCas-1 and LIGCas-2 locus.

SEQ ID NOs: 56-65 are the nucleotide sequences of mutations 1-10 for LIGCas-1.

SEQ ID NOs: 66-75 are the nucleotide sequences of mutations 1-10 for LIGCas-2.

SEQ ID NO: 76 is the nucleotide sequence of the unmodified reference sequence for the LIGCas-3 and LIG3-4 homing endonuclease locus.

SEQ ID NOs: 77-86 are the nucleotide sequences of mutations 1-10 for LIGCas-3.

SEQ ID NOs: 88-96 are the nucleotide sequences of mutations 1-10 for LIG3-4 homing endonuclease locus.

SEQ ID NO: 97 is the nucleotide sequence of a donor vector referred to as an HR Repair DNA.

SEQ ID NO: 98 is the nucleotide sequence of forward PCR primer for site-specific transgene insertion at junction 1.

SEQ ID NO: 99 is the nucleotide sequence of reverse PCR primer for site-specific transgene insertion at junction 1.

SEQ ID NO: 100 is the nucleotide sequence of forward PCR primer for site-specific transgene insertion at junction 2.

SEQ ID NO: 101 is the nucleotide sequence of reverse PCR primer for site-specific transgene insertion at junction 2.

SEQ ID NO: 102 is the nucleotide sequence of the linked Cas9 endonuclease and LIGCas-3 long guide RNA expression cassettes SEQ ID NO: 103 is the nucleotide sequence of Maize genomic target site 55CasRNA-1 plus PAM sequence.

SEQ ID NO: 104 is the nucleotide sequence of the unmodified reference sequence for 55CasRNA-1 locus.

SEQ ID NOs: 105-110 are the nucleotide sequences of mutations 1-6 for 55CasRNA-1.

SEQ ID NO: 111 is the nucleotide sequence of LIG3-4 homing endonuclease target site SEQ ID NO: 112 is the nucleotide sequence of LIG3-4 homing endonuclease coding sequence.

SEQ ID NO: 113 is the nucleotide sequence of the MS26++ homing endonuclease target site.

SEQ ID NO: 114 is the nucleotide sequence of MS26++ homing endonuclease coding sequence SEQ ID NO: 115 is the nucleotide sequence of the soybean codon optimized Cas9 gene.

SEQ ID NO: 116 is the nucleotide sequence of the soybean constitutive promoter GM-EF1A2.

SEQ ID NO: 117 is the nucleotide sequence of linker SV40 NLS.

SEQ ID NO: 118 is the amino acid sequence of soybean optimized Cas9 with a SV40 NLS.

SEQ ID NO: 119 is the nucleotide sequence of vector QC782.

SEQ ID NO: 120 is the nucleotide sequence of soybean U6 polymerase III promoter described herein, GM-U6-13.1 PRO.

SEQ ID NO: 121 is the nucleotide sequence of the guide RNA in FIG. 8B.

SEQ ID NO: 122 is the nucleotide sequence of vector QC783.

SEQ ID NO: 123 is the nucleotide sequence of vector QC815.

SEQ ID NO: 124 is the nucleotide sequence of a Cas9 endonuclease (cas9-2) from *S. pyogenes*.

SEQ ID NO: 125 is the nucleotide sequence of the DD20CR1 soybean target site

SEQ ID NO: 126 is the nucleotide sequence of the DD20CR2 soybean target site

SEQ ID NO: 127 is the nucleotide sequence of the DD43CR1 soybean target site

SEQ ID NO: 128 is the nucleotide sequence of the DD43CR2 soybean target site

SEQ ID NO: 129 is the nucleotide sequence of the DD20 sequence in FIG. 10A.

SEQ ID NO: 130 is the nucleotide sequence of the DD20 sequence complementary in FIG. 10A.

SEQ ID NO: 131 is the nucleotide sequence of DD43 sequence.

SEQ ID NO: 132 is the nucleotide sequence of the DD43 complementary sequence.

SEQ ID NO: 133-141 are primer sequences.

SEQ ID NO: 142 is the nucleotide sequence of the DD20CR1 PCR amplicon.

SEQ ID NO: 143 is the nucleotide sequence of the DD20CR2 PCR amplicon.

SEQ ID NO: 144 is the nucleotide sequence of the DD43CR1 PCR amplicon.

SEQ ID NO: 145 is the nucleotide sequence of the DD43CR2 PCR amplicon.

SEQ ID NO: 146 is the nucleotide sequence of the DD43CR2 PCR amplicon.

SEQ ID NO: 147-156 are the nucleotide sequence of mutations 1 to 10 for the DD20CR1 target site SEQ ID NO: 157-166 are the nucleotide sequence of mutations 1 to 10 for the DD20CR2 target site SEQ ID NO: 167-176 are the nucleotide sequence of mutations 1 to 10 for the DD43CR1 target site SEQ ID NO: 177-191 are the nucleotide sequence of mutations 1 to 10 for the DD43CR2 target site.

SEQ ID NO: 192 is the amino acid sequence of a maize optimized version of the Cas9 protein.

SEQ ID NO: 193 is the nucleotide sequence of the maize optimized version of the Cas9 gene of SEQ ID NO: 192.

SEQ ID NO: 194 is the DNA version of guide RNA (EPSPS sgRNA).

SEQ ID NO: 195 is the EPSPS polynucleotide modification template.

SEQ ID NO: 196 is a nucleotide fragment comprising the TIPS nucleotide modifications.

SEQ ID NO: 197-204 are primer sequences shown in Table 15.

SEQ ID NO: 205-208 are nucleotide fragments shown in FIG. 14.

SEQ ID NO: 209 is an example of a TIPS edited EPSPS nucleotide sequence fragment shown in FIG. 17 A, B.

SEQ ID NO: 210 is an example of a Wild-type EPSPS nucleotide sequence fragment shown in FIG. 17 A, B.

SEQ ID NO: 211 is the nucleotide sequence of a maize enolpyruvylshikimate-3-phosphate synthase (epsps) locus SEQ ID NO: 212 is the nucleotide sequence of a Cas9 endonuclease (genbank CS571758.1) from *S. thermophiles*.

SEQ ID NO: 213 is the nucleotide sequence of a Cas9 endonuclease (genbank CS571770.1) from *S. thermophiles*.

SEQ ID NO: 214 is the nucleotide sequence of a Cas9 endonuclease (genbank CS571785.1) from *S. agalactiae*.

SEQ ID NO: 215 is the nucleotide sequence of a Cas9 endonuclease, (genbank CS571790.1) from *S. agalactiae*.

SEQ ID NO: 216 is the nucleotide sequence of a Cas9 endonuclease (genbank CS571790.1) from *S. mutant*.

SEQ ID NOs: 217-228 are primer and probe nucleotide sequences described in Example 17.

SEQ ID NOs: 229 is the nucleotide sequence of the MHP14Cas1 target site.

SEQ ID NOs: 230 is the nucleotide sequence of the MHP14Cas3 target site.

SEQ ID NOs: 231 is the nucleotide sequence of the TS8Cas1 target site.

SEQ ID NOs: 232 is the nucleotide sequence of the TS8Cas2 target site.

SEQ ID NOs: 233 is the nucleotide sequence of the TS9Cas2 target site.

SEQ ID NOs: 234 is the nucleotide sequence of the TS9Cas3 target site.

SEQ ID NOs: 235 is the nucleotide sequence of the TS10Cas1 target site.

SEQ ID NOs: 236 is the nucleotide sequence of the TS10Cas3 target site.

SEQ ID NOs: 237-244 are the nucleotide sequences shown in FIG. 19A-D.

SEQ ID NOs: 245-252 are the nucleotide sequences of the guide RNA expression cassettes described in Example 18.

SEQ ID NOs: 253-260 are the nucleotide sequences of donor DNA expression cassettes described in Example 18.

SEQ ID NOs: 261-270 are the nucleotide sequences of the primers described in Example 18.

SEQ ID NOs: 271-294 are the nucleotide sequences of the primers and probes described in Example 18.

SEQ ID NO: 295 is the nucleotide sequence of GM-U6-13.1 PRO, a soybean U6 polymerase III promoter described herein, SEQ ID NOs: 298, 300, 301 and 303 are the nucleotide sequences of the linked guideRNA/Cas9 expression cassettes.

SEQ ID NOs: 299 and 302 are the nucleotide sequences of the donor DNA expression cassettes.

SEQ ID NOs: 271-294 are the nucleotide sequences of the primers and probes described in Example 18.

SEQ ID NO: 304 is the nucleotide sequence of the DD20 qPCR amplicon.

SEQ ID NO: 305 is the nucleotide sequence of the DD43 qPCR amplicon.

SEQ ID NOs: 306-328 are the nucleotide sequences of the primers and probes described herein.

SEQ ID NOs: 329-334 are the nucleotide sequences of PCR amplicons described herein.

SEQ ID NO: 335 is the nucleotide sequence of a soybean genomic region comprising the DD20CR1 target site.

SEQ ID NO: 364 is the nucleotide sequence of a soybean genomic region comprising the DD20CR2 target site.

SEQ ID NO: 386 is the nucleotide sequence of a soybean genomic region comprising the DD43CR1 target site.

SEQ ID NOs: 336-363, 365-385 and 387-414 are the nucleotide sequences of shown in FIG. 26 A-C.

SEQ ID NOs: 415-444 are the nucleotide sequences of NHEJ mutations recovered based on the crRNA/tracrRNA/Cas endonuclease system shown in FIG. 27A-C.

SEQ ID NO: 445-447 are the nucleotide sequence of the LIGCas-1, LIGCas2 and LIGCas3 crRNA expression cassettes, respectively.

SEQ ID NO: 448 is the nucleotide sequence of the tracrRNA expression cassette.

SEQ ID NO: 449 is the nucleotide sequence of LIGCas-2 forward primer for primary PCR SEQ ID NO: 450 is the nucleotide sequence of LIGCas-3 forward primer for primary PCR.

SEQ ID NO: 451 is the nucleotide sequence of the maize genomic Cas9 endonuclease target site Zm-ARGOS8-CTS1.

SEQ ID NO: 452 is the nucleotide sequence of the maize genomic Cas9 endonuclease target site Zm-ARGOS8-CTS2.

SEQ ID NO: 453 is the nucleotide sequence of the maize genomic Cas9 endonuclease target site Zm-ARGOS8-CTS3

SEQ ID NOs: 454-458 are the nucleotide sequence of primers P1, P2, P3, P4, P5, respectively.

SEQ ID NO: 459 is the nucleotide sequence of a Primer Binding Site (PBS), a sequence to facilitate event screening.

SEQ ID NO: 460 is the nucleotide sequence of the Zm-GOS2 PRO-GOS2 INTRON, the maize GOS2 promoter and GOS2 intron1 including the promoter, 5'-UTR1, INTRON1 and 5'-UTR2.

SEQ ID NO:461 is the nucleotide sequence of the maize Zm-ARGOS8 promoter.

SEQ ID NO:462 is the nucleotide sequence of the maize Zm-ARGOS8 5'-UTR.

SEQ ID NO:463 is the nucleotide sequence of the maize Zm-ARGOS8 codon sequence

SEQ ID NO:464 is the nucleotide sequence of the maize Zm-GOS2 gene, including promoter, 5'-UTR, CDS, 3'-UTR and introns.

SEQ ID NO:465 is the nucleotide sequence of the maize Zm-GOS2 PRO promoter.

SEQ ID NO:466 is the nucleotide sequence of the maize GOS2 INTRON, maize GOS2 5'-UTR1 and intron1 and 5'-UTR2.

SEQ ID NOs: 467-468, 490-491, 503-504 are the nucleotide sequence of the soybean genomic Cas endonuclease target sequences soy EPSPS-CR1, soy EPSPS-CR2, soy EPSPS-CR4, soy EPSPS-CR5, soy EPSPS-CR6, soy EPSPS-CR7, respectively SEQ ID NO:469 is the nucleotide sequence of the soybean U6 small nuclear RNA promoter GM-U6-13.1.

SEQ ID NOs:470, 471 are the nucleotide sequences of the QC868, QC879 plasmids, respectively.

SEQ ID NOs:472, 473, 492, 493, 494, 505, 506, 507 are the nucleotide sequences of the RTW1013A, RTW1012A, RTW1199, RTW1200, RTW1190A, RTW1201, RTW1202, RTW1192A respectively.

SEQ ID NOs:474-488, 495-402, 508-512 are the nucleotide sequences of primers and probes.

SEQ ID NO: 489 is the nucleotide sequence of the soybean codon optimized Cas9.

SEQ ID NO: 513 is the nucleotide sequence of the 35S enhancer.

SEQ ID NO: 514 is the nucleotide sequence of the 35S-CRTS for gRNA1 at 163-181 (including pam at 3'end).

SEQ ID NO: 515 is the nucleotide sequence of the 35S-CRTS for gRNA2 at 295-319 (including pam at 3'end).

SEQ ID NO: 516 is the nucleotide sequence of the 35S-CRT for gRNA3 at 331-350 (including pam at 3'end).

SEQ ID NO: 517 is the nucleotide sequence of the EPSPS-K90R template.

SEQ ID NO: 518 is the nucleotide sequence of the EPSPS-IME template. S SEQ ID NO: 519 is the nucleotide sequence of the EPSPS-Tspliced template.

SEQ ID NO: 520 is the amino acid sequence of ZM-RAP2.7 peptide

SEQ ID NO: 521 is the nucleotide sequence zM-RAP2.7 coding DNA sequence

SEQ ID NOs: 522 is the amino acid sequence of ZM-NPK1B peptide

SEQ ID NO: 523 is the nucleotide sequence of the ZM-NPK1B coding DNA sequence

SEQ ID NOs: 524 is the nucleotide sequence of the RAB17 promoter

SEQ ID NOs: 525 is the amino acid sequence of the Maize FTM1.

SEQ ID NO: 526 is the nucleotide sequence of the Maize FTM1 coding DNA sequence.

SEQ ID NOs: 527-532 are the nucleotide sequences shown in FIGS. 34, 35 and 37.

SEQ ID NOs: 533-534 are the nucleotide sequences of the Southern genomic probe and Southern MoPAT probe of FIG. 38, respectively. SEQ ID NOs: 535-541 are the nucleotide sequences of the RF-FPCas-1, RF-FPCas-2, ALSCas-4, ALS modification repair template 804, ALS modification repair template 127, ALS Forward_primer and ALS Reverse_primer, respectively.

SEQ ID NOs: 542-549 are the nucleotide sequences of the soy ALS1-CR1, Cas9 target sequence, soy ALS2-CR2, Cas9 target sequence, QC880, QC881, RTW1026A, WOL900, Forward_primer, WOL578, Reverse_primer and WOL573, Forward_primer, respectively.

SEQ ID NO: 550 is the nucleotide sequence of a maize ALS protein.

SEQ ID NOs: 551-554 are the nucleotide sequences of the soy FAD2-1-CR1, Cas9 target sequence, soy FAD2-1-CR2, Cas9 target sequence, RTW1211 and RTW1212.

DETAILED DESCRIPTION

The present disclosure includes compositions and methods for genome modification of a target sequence in the genome of a plant or plant cell, for selecting plants, for gene editing, and for inserting a polynucleotide of interest into the genome of a plant without incorporating a selectable transgene marker. The methods employ a guide polynucleotide/Cas endonuclease system, wherein the Cas endonuclease is guided by at least two guide polynucleotides to recognize and optionally introduce a double strand break at a specific first and second target site into the genome of a cell. The guide polynucleotide/Cas endonuclease system provides for an effective system for modifying target sites within the genome of a plant, plant cell or seed. Further provided are methods and compositions employing a guide polynucleotide/Cas endonuclease for editing a nucleotide sequence in the genome of a cell. Once a genomic target site is identified, a variety of methods can be employed to further modify the target sites such that they contain a variety of polynucleotides of interest. Breeding methods utilizing a two component guide RNA/Cas endonuclease system are also disclosed. Compositions and methods are also provided for editing a nucleotide sequence in the genome of a cell. The nucleotide sequence to be edited (the nucleotide sequence of interest) can be located within or outside a target site that is recognized by a Cas endonuclease.

CRISPR loci (Clustered Regularly Interspaced Short Palindromic Repeats) (also known as SPIDRs—SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007).

CRISPR loci were first recognized in *E. coli* (Ishino et al. (1987) J. Bacterial. 169:5429-5433; Nakata et al. (1989) J. Bacterial. 171:3553-3556). Similar interspersed short sequence repeats have been identified in *Haloferax mediterranei, Streptococcus pyogenes, Anabaena*, and *Mycobacterium tuberculosis* (Groenen et al. (1993) Mol. Microbiol. 10:1057-1065; Hoe et al. (1999) Emerg. Infect. Dis. 5:254-263; Masepohl et al. (1996) Biochim. Biophys. Acta 1307: 26-30; Mojica et al. (1995) Mol. Microbiol. 17:85-93). The CRISPR loci differ from other SSRs by the structure of the repeats, which have been termed short regularly spaced repeats (SRSRs) (Janssen et al. (2002) OMICS J. Integ. Biol. 6:23-33; Mojica et al. (2000) Mol. Microbiol. 36:244-246). The repeats are short elements that occur in clusters, which are always regularly spaced by variable sequences of constant length (Mojica et al. (2000) Mol. Microbiol. 36:244-246).

Cas gene includes a gene that is generally coupled, associated or close to or in the vicinity of flanking CRISPR loci. The terms "Cas gene", "CRISPR-associated (Cas) gene" are used interchangeably herein. A comprehensive review of the Cas protein family is presented in Haft et al. (2005) Computational Biology, PLoS Comput Biol 1(6): e60. doi:10.1371/journal.pcbi.0010060.

As described therein, 41 CRISPR-associated (Cas) gene families are described, in addition to the four previously known gene families. It shows that CRISPR systems belong to different classes, with different repeat patterns, sets of genes, and species ranges. The number of Cas genes at a given CRISPR locus can vary between species.

Cas endonuclease relates to a Cas protein encoded by a Cas gene, wherein said Cas protein is capable of introducing a double strand break into a DNA target sequence. The Cas endonuclease is guided by the guide polynucleotide to recognize and optionally introduce a double strand break at a specific target site into the genome of a cell. As used herein, the tem "guide polynucleotide/Cas endonuclease system" includes a complex of a Cas endonuclease and a guide polynucleotide that is capable of introducing a double strand break into a DNA target sequence. The Cas endonuclease unwinds the DNA duplex in close proximity of the genomic target site and cleaves both DNA strands upon recognition of a target sequence by a guide RNA, but only if the correct protospacer-adjacent motif (PAM) is approximately oriented at the 3' end of the target sequence (FIG. 2A, FIG. 2B).

In one embodiment, the Cas endonuclease gene is a Cas9 endonuclease, such as but not limited to, Cas9 genes listed in SEQ ID NOs: 462, 474, 489, 494, 499, 505, and 518 of WO2007/025097 published Mar. 1, 2007, and incorporated herein by reference. In another embodiment, the Cas endonuclease gene is plant, maize or soybean optimized Cas9 endonuclease (FIG. 1 A). In another embodiment, the Cas endonuclease gene is operably linked to a SV40 nuclear targeting signal upstream of the Cas codon region and a bipartite VirD2 nuclear localization signal (Tinland et al. (1992) Proc. Natl. Acad. Sci. USA 89:7442-6) downstream of the Cas codon region.

In one embodiment, the Cas endonuclease gene is a Cas9 endonuclease gene of SEQ ID NO:1, 124, 212, 213, 214, 215, 216, 193 or nucleotides 2037-6329 of SEQ ID NO:5, or any functional fragment or variant thereof.

The terms "functional fragment", "fragment that is functionally equivalent" and "functionally equivalent fragment" are used interchangeably herein. These terms refer to a portion or subsequence of the Cas endonuclease sequence of the present disclosure in which the ability to create a double-strand break is retained.

The terms "functional variant", "Variant that is functionally equivalent" and "functionally equivalent variant" are used interchangeably herein. These terms refer to a variant of the Cas endonuclease of the present disclosure in which the ability create a double-strand break is retained. Fragments and variants can be obtained via methods such as site-directed mutagenesis and synthetic construction.

In one embodiment, the Cas endonuclease gene is a plant codon optimized *Streptococcus pyogenes* Cas9 gene that can recognize any genomic sequence of the form N(12-30)NGG can in principle be targeted.

In one embodiment, the Cas endonuclease is introduced directly into a cell by any method known in the art, for example, but not limited to transient introduction methods, transfection and/or topical application.

Endonucleases are enzymes that cleave the phosphodiester bond within a polynucleotide chain, and include restriction endonucleases that cleave DNA at specific sites without damaging the bases. Restriction endonucleases include Type I, Type II, Type III, and Type IV endonucleases, which further include subtypes. In the Type I and Type III systems, both the methylase and restriction activities are contained in a single complex. Endonucleases also include meganucleases, also known as homing endonucleases (HEases), which like restriction endonucleases, bind and cut at a specific recognition site, however the recognition sites for meganucleases are typically longer, about 18 bp or more. (patent application WO-PCT PCT/US12/30061 filed on Mar. 22, 2012) Meganucleases have been classified into four families based on conserved sequence motifs, the families are the LAGLIDADG, GIY-YIG, H-N-H, and His-Cys box families. These motifs participate in the coordination of metal ions and hydrolysis of phosphodiester bonds. HEases are notable for their long recognition sites, and for tolerating some sequence polymorphisms in their DNA substrates. The naming convention for meganuclease is similar to the convention for other restriction endonuclease. Meganucleases are also characterized by prefix F-, I-, or PI- for enzymes encoded by free-standing ORFs, introns, and inteins, respectively. One step in the recombination process involves polynucleotide cleavage at or near the recognition site. This cleaving activity can be used to produce a double-strand break. For reviews of site-specific recombinases and their recognition sites, see, Sauer (1994) Curr Op Biotechnol 5:521-7; and Sadowski (1993) FASEB 7:760-7. In some examples the recombinase is from the Integrase or Resolvase families.

TAL effector nucleases are a new class of sequence-specific nucleases that can be used to make double-strand breaks at specific target sequences in the genome of a plant or other organism. (Miller et al. (2011) *Nature Biotechnology* 29:143-148). Zinc finger nucleases (ZFNs) are engineered double-strand break inducing agents comprised of a zinc finger DNA binding domain and a double-strand-break-inducing agent domain. Recognition site specificity is conferred by the zinc finger domain, which typically comprising two, three, or four zinc fingers, for example having a C2H2 structure, however other zinc finger structures are known and have been engineered. Zinc finger domains are amenable for designing polypeptides which specifically bind a selected polynucleotide recognition sequence. ZFNs include an engineered DNA-binding zinc finger domain linked to a non-specific endonuclease domain, for example nuclease domain from a Type IIs endonuclease such as FokI. Additional functionalities can be fused to the zinc-finger binding domain, including transcriptional activator domains, transcription repressor domains, and methylases. In some examples, dimerization of nuclease domain is required for cleavage activity. Each zinc finger recognizes three consecutive base pairs in the target DNA. For example, a 3 finger domain recognized a sequence of 9 contiguous nucleotides, with a dimerization requirement of the nuclease, two sets of zinc finger triplets are used to bind an 18 nucleotide recognition sequence.

Bacteria and archaea have evolved adaptive immune defenses termed clustered regularly interspaced short palindromic repeats (CRISPR)/CRISPR-associated (Cas) systems that use short RNA to direct degradation of foreign nucleic acids ((WO2007/025097 published Mar. 1, 2007). The type II CRISPR/Cas system from bacteria employs a crRNA and tracrRNA to guide the Cas endonuclease to its DNA target. The crRNA (CRISPR RNA) contains the region complementary to one strand of the double strand DNA target and base pairs with the tracrRNA (trans-activating CRISPR RNA) forming a RNA duplex that directs the Cas endonuclease to cleave the DNA target (FIG. 2 B).

As used herein, the term "guide RNA" includes a synthetic fusion of two RNA molecules, a crRNA (CRISPR RNA) comprising a variable targeting domain, and a tracrRNA (FIG. 2 B). In one embodiment, the guide RNA comprises a variable targeting domain of 12 to 30 nucleotide sequences and a RNA fragment that can interact with a Cas endonuclease.

As used herein, the term "guide polynucleotide", includes a polynucleotide sequence that can form a complex with a Cas endonuclease and enables the Cas endonuclease to recognize and optionally cleave a DNA target site. The guide polynucleotide can be included a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide RNA".

The guide polynucleotide can be a double molecule (also referred to as duplex guide polynucleotide) comprising a first nucleotide sequence domain (referred to as Variable Targeting domain or VT domain) that is complementary to a nucleotide sequence in a target DNA and a second nucleotide sequence domain (referred to as Gas endonuclease recognition domain or CER domain) that interacts with a Cas endonuclease polypeptide. The CER domain of the double molecule guide polynucleotide comprises two separate molecules that are hybridized along a region of complementarity. The two separate molecules can be RNA, DNA, and/or RNA-DNA-combination sequences. In some embodiments, the first molecule of the duplex guide polynucleotide comprising a VT domain linked to a CER domain is referred to as "crDNA" (when composed of a contiguous stretch of DNA nucleotides) or "crRNA" (when composed of a contiguous stretch of RNA nucleotides), or "crDNA-RNA" (when composed of a combination of DNA and RNA nucleotides). The crNucleotide can comprise a fragment of the cRNA naturally occurring in Bacteria and Archaea. In one embodiment, the size of the fragment of the cRNA naturally occurring in Bacteria and Archaea that is present in a crNucleotide disclosed herein can range from, but is not limited to, 2, 3, 4, 5, 6, 7, 8, 9, 10, 11, 12, 13, 14, 15, 16, 17, 18, 19, 20 or more nucleotides. In some embodiments the second molecule of the duplex guide polynucleotide comprising a CER domain is referred to as "tracrRNA" (when composed of a contiguous stretch of RNA nucleotides) or "tracrDNA" (when composed of a contiguous stretch of DNA nucleotides) or "tracrDNA-RNA" (when composed of a combination of DNA and RNA nucleotides In one embodiment, the RNA that guides the RNA/Cas9 endonuclease complex, is a duplexed RNA comprising a duplex crRNA-tracrRNA.

The guide polynucleotide can also be a single molecule comprising a first nucleotide sequence domain (referred to as Variable Targeting domain or VT domain) that is complementary to a nucleotide sequence in a target DNA and a second nucleotide domain (referred to as Cas endonuclease recognition domain or CER domain) that interacts with a Cas endonuclease polypeptide. By "domain" it is meant a contiguous stretch of nucleotides that can be RNA, DNA, and/or RNA-DNA-combination sequence. The VT domain and/or the CER domain of a single guide polynucleotide can comprise a RNA sequence, a DNA sequence, or a RNA-DNA-combination sequence. In some embodiments the single guide polynucleotide comprises a crNucleotide (comprising a VT domain linked to a CER domain) linked to a tracrNucleotide (comprising a CER domain), wherein the linkage is a nucleotide sequence comprising a RNA sequence, a DNA sequence, or a RNA-DNA combination sequence. The single guide polynucleotide being comprised of sequences from the crNucleotide and tracrNucleotide may be referred to as "single guide RNA" (when composed of a contiguous stretch of RNA nucleotides) or "single guide DNA" (when composed of a contiguous stretch of DNA nucleotides) or "single guide RNA-DNA" (when composed of a combination of RNA and DNA nucleotides). In one embodiment of the disclosure, the single guide RNA comprises a cRNA or cRNA fragment and a tracrRNA or tracrRNA fragment of the type II CRISPR/Cas system that can form a complex with a type II Cas endonuclease, wherein said guide RNA/Cas endonuclease complex can direct the Cas endonuclease to a plant genomic target site, enabling the Cas endonuclease to introduce a double strand break into the genomic target site. One aspect of using a single guide polynucleotide versus a duplex guide polynucleotide is that only one expression cassette needs to be made to express the single guide polynucleotide.

The term "variable targeting domain" or "VT domain" is used interchangeably herein and includes a nucleotide sequence that is complementary to one strand (nucleotide sequence) of a double strand DNA target site (FIGS. 2 A and 2 B). The % complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable target domain can be at least 12, 13, 14, 15, 16, 17, 18, 19, 20, 21, 22, 23, 24, 25, 26, 27, 28, 29 or 30 nucleotides in length. In some embodiments, the variable targeting domain comprises a contiguous stretch of 12 to 30 nucleotides. The variable targeting domain can be composed of a DNA sequence, a RNA sequence, a modified DNA sequence, a modified RNA sequence, or any combination thereof.

The term "Cas endonuclease recognition domain" or "CER domain" of a guide polynucleotide is used interchangeably herein and includes a nucleotide sequence (such as a second nucleotide sequence domain of a guide polynucleotide), that interacts with a Cas endonuclease polypeptide. The CER domain can be composed of a DNA sequence, a RNA sequence, a modified DNA sequence, a modified RNA sequence (see for example modifications described herein), or any combination thereof.

The nucleotide sequence linking the crNucleotide and the tracrNucleotide of a single guide polynucleotide can comprise a RNA sequence, a DNA sequence, or a RNA-DNA combination sequence. In one embodiment, the nucleotide sequence linking the crNucleotide and the tracrNucleotide of a single guide polynucleotide can be at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 78, 79, 80, 81, 82, 83, 84, 85, 86, 87, 88, 89, 90, 91, 92, 93, 94, 95, 96, 97, 98, 99 or 100 nucleotides in length. In another embodiment, the nucleotide sequence linking the crNucleotide and the tracrNucleotide of a single guide polynucleotide can comprise a tetraloop sequence, such as, but not limiting to a GAAA tetraloop sequence.

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

In one embodiment, the guide RNA and Cas endonuclease are capable of forming a complex that enables the Cas endonuclease to introduce a double strand break at a DNA target site In one embodiment of the disclosure the variable target domain is 12, 13, 14, 15, 16, 17, 18, 19, 20, 21, 22, 23, 24, 25, 26, 27, 28, 29 or 30 nucleotides in length.

In one embodiment of the disclosure, the guide RNA comprises a cRNA (or cRNA fragment) and a tracrRNA (or tracrRNA fragment) of the type II CRISPR/Cas system that can form a complex with a type II Cas endonuclease, wherein said guide RNA/Cas endonuclease complex can direct the Cas endonuclease to a plant genomic target site, enabling the Cas endonuclease to introduce a double strand break into the genomic target site.

In one embodiment the guide RNA can be introduced into a plant or plant cell directly using any method known in the art such as, but not limited to, particle bombardment or topical applications.

In another embodiment the guide RNA can be introduced indirectly by introducing a recombinant DNA molecule comprising the corresponding guide DNA sequence operably linked to a plant specific promoter (as shown in FIG. 1 B) that is capable of transcribing the guide RNA in said plant cell. The term "corresponding guide DNA" includes a DNA molecule that is identical to the RNA molecule but has a "T" substituted for each "U" of the RNA molecule.

In some embodiments, the guide RNA is introduced via particle bombardment or *Agrobacterium* transformation of a recombinant DNA construct comprising the corresponding guide DNA operably linked to a plant U6 polymerase III promoter.

In one embodiment, the RNA that guides the RNA/Cas9 endonuclease complex, is a duplexed RNA comprising a duplex crRNA-tracrRNA (as shown in FIG. 2B). One advantage of using a guide RNA versus a duplexed crRNA-tracrRNA is that only one expression cassette needs to be made to express the fused guide RNA.

The terms "target site", "target sequence", "target DNA", "target locus", "genomic target site", "genomic target sequence", and "genomic target locus" are used interchangeably herein and refer to a polynucleotide sequence in the genome (including choroplastic and mitochondrial DNA) of a plant cell at which a double-strand break is induced in the plant cell genome by a Cas endonuclease. The target site can be an endogenous site in the plant genome, or alternatively, the target site can be heterologous to the plant and thereby not be naturally occurring in the genome, or the target site can be found in a heterologous genomic location compared to where it occurs in nature. As used herein, terms "endogenous target sequence" and "native target sequence" are used interchangeable herein to refer to a target sequence that is endogenous or native to the genome of a plant and is at the endogenous or native position of that target sequence in the genome of the plant.

In one embodiments, the target site can be similar to a DNA recognition site or target site that that is specifically recognized and/or bound by a double-strand break inducing agent such as a LIG3-4 endonuclease (US patent publication 2009-0133152 A1 (published May 21, 2009) or a MS26++ meganuclease (U.S. patent application Ser. No. 13/526,912 filed Jun. 19, 2012).

An "artificial target site" or "artificial target sequence" are used interchangeably herein and refer to a target sequence that has been introduced into the genome of a plant. Such an artificial target sequence can be identical in sequence to an endogenous or native target sequence in the genome of a plant but be located in a different position (i.e., a non-endogenous or non-native position) in the genome of a plant.

An "altered target site", "altered target sequence", "modified target site", "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

Methods for modifying a plant genomic target site are disclosed herein. In one embodiment, the method comprises a method for producing a genetic modification into a second gene of a plant genome without introducing an exogenous selectable marker into said plant genome, the method comprising providing a first guide polynucleotide, a polynucleotide modification template, a second guide polynucleotide, and a Cas endonuclease to a plant cell comprising a first endogenous gene that can be modified to confer herbicide resistance, wherein said first guide polynucleotide and Cas endonuclease are capable of forming a first complex that enables the Cas endonuclease to introduce a double strand break at a first target site, located in or near said first endogenous gene in the genome of said plant cell, wherein said second guide polynucleotide and Cas endonuclease are capable of forming a second complex that enables the Cas endonuclease to introduce a double strand break at a second target site in the genome of said plant cell, wherein said polynucleotide modification template comprises at least one nucleotide alteration when compared to the first endogenous gene.

Also provided is a method for modifying a target site in the genome of a plant cell, the method comprising introducing a guide RNA and a Cas endonuclease into said plant, wherein said guide RNA and Cas endonuclease are capable of forming a complex that enables the Cas endonuclease to introduce a double strand break at said target site.

Further provided is a method for modifying a target site in the genome of a plant cell, the method comprising introducing a guide RNA and a donor DNA into a plant cell having a Cas endonuclease, wherein said guide RNA and Cas endonuclease are capable of forming a complex that enables the Cas endonuclease to introduce a double strand break at said target site, wherein said donor DNA comprises a polynucleotide of interest.

Further provided is a method for modifying a target site in the genome of a plant cell, the method comprising: a) introducing into a plant cell a guide RNA comprising a variable targeting domain and a Cas endonuclease, wherein said guide RNA and Cas endonuclease are capable of forming a complex that enables the Cas endonuclease to introduce a double strand break at said target site; and, b) identifying at least one plant cell that has a modification at said target, wherein the modification includes at least one deletion or substitution of one or more nucleotides in said target site.

Further provided, a method for modifying a target DNA sequence in the genome of a plant cell, the method comprising: a) introducing into a plant cell a first recombinant DNA construct capable of expressing a guide RNA and a second recombinant DNA construct capable of expressing a Cas endonuclease, wherein said guide RNA and Cas endonuclease are capable of forming a complex that enables the Cas endonuclease to introduce a double strand break at said target site; and, b) identifying at least one plant cell that has a modification at said target, wherein the modification includes at least one deletion or substitution of one or more nucleotides in said target site.

The length of the target site can vary, and includes, for example, target sites that are at least 12, 13, 14, 15, 16, 17, 18, 19, 20, 21, 22, 23, 24, 25, 26, 27, 28, 29, 30 or more nucleotides in length. It is further possible that the target site can be palindromic, that is, the sequence on one strand reads the same in the opposite direction on the complementary strand. The nick/cleavage site can be within the target sequence or the nick/cleavage site could be outside of the target sequence. In another variation, the cleavage could occur at nucleotide positions immediately opposite each other to produce a blunt end cut or, in other Cases, the incisions could be staggered to produce single-stranded overhangs, also called "sticky ends", which can be either 5' overhangs, or 3' overhangs.

In some embodiment, the genomic target site capable of being cleaved by a Cas endonuclease comprises a 12 to 30 nucleotide fragment of a male fertility gene such as MS26 (see for example U.S. Pat. Nos. 7,098,388, 7,517,975, 7,612,251), MS45 (see for example U.S. Pat. Nos. 5,478, 369, 6,265,640) or MSCA1 (see for example U.S. Pat. No. 7,919,676), ALS or ESPS genes.

Active variants of genomic target sites can also be used. Such active variants can comprise at least 65%, 70%, 75%, 80%, 85%, 90%, 91%, 92%, 93%, 94%, 95%, 96%, 97%, 98%, 99% or more sequence identity to the given target site, wherein the active variants retain biological activity and hence are capable of being recognized and cleaved by an Cas endonuclease. Assays to measure the double-strand break of a target site by an endonuclease are known in the art and generally measure the overall activity and specificity of the agent on DNA substrates containing recognition sites.

Various methods and compositions can be employed to obtain a plant having a polynucleotide of interest inserted in a target site for a Cas endonuclease. Such methods can employ homologous recombination to provide integration of the polynucleotide of Interest at the target site. In one method provided, a polynucleotide of interest is provided to the plant cell in a donor DNA construct. As used herein, "donor DNA" is a DNA construct that comprises a polynucleotide of Interest to be inserted into the target site of a Cas endonuclease. The donor DNA construct further comprises a first and a second region of homology that flank the polynucleotide of Interest. The first and second regions of homology of the donor DNA share homology to a first and a second genomic region, respectively, present in or flanking the target site of the plant genome. By "homology" is meant DNA sequences that are similar. For example, a "region of homology to a genomic region" that is found on the donor DNA is a region of DNA that has a similar sequence to a given "genomic region" in the plant genome. A region of homology can be of any length that is sufficient to promote homologous recombination at the cleaved target site. For example, the region of homology can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800. 5-2900, 5-3000, 5-3100 or more bases in length such that the region of homology has sufficient homology to undergo homologous recombination with the corresponding genomic region. "Sufficient homology" indicates that two polynucleotide sequences have sufficient structural similarity to act as substrates for a homologous recombination reaction. The structural similarity includes overall length of each polynucleotide fragment, as well as the sequence similarity of the polynucleotides. Sequence similarity can be described by the percent sequence identity over the whole length of the sequences, and/or by conserved regions comprising localized similarities such as contiguous nucleotides having 100% sequence identity, and percent sequence identity over a portion of the length of the sequences.

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bp. The amount of homology can also described by percent sequence identity over the full aligned length of the two polynucleotides which includes percent sequence identity of about at least 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. Sufficient homology includes any combination of polynucleotide length, global percent sequence identity, and optionally conserved regions of contiguous nucleotides or local percent sequence identity, for example sufficient homology can be described as a region of 75-150 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) Current Protocols, (Greene Publishing Associates, Inc. and John Wiley & Sons, Inc); and, Tijssen (1993) *Laboratory Techniques in Biochemistry and Molecular Biology—Hybridization with Nucleic Acid Probes*, (Elsevier, New York).

As used herein, a "genomic region" is a segment of a chromosome in the genome of a plant cell that is present on either side of the target site or, alternatively, also comprises a portion of the target site. The genomic region can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800. 5-2900, 5-3000, 5-3100 or more bases such that the genomic region has sufficient homology to undergo homologous recombination with the corresponding region of homology.

Polynucleotides of interest and/or traits can be stacked together in a complex trait locus as described in US-2013-0263324-A1, published 3 Oct. 2013 and in PCT/US13/22891, published Jan. 24, 2013, both applications are hereby incorporated by reference. The guide polynucleotide/Cas9 endonuclease system described herein provides for an efficient system to generate double strand breaks and allows for traits to be stacked in a complex trait locus.

In one embodiment, the guide polynucleotide/Cas endonuclease system is used for introducing one or more polynucleotides of interest or one or more traits of interest into one or more target sites by providing one or more guide polynucleotides, one Cas endonuclease, and optionally one or more donor DNAs to a plant cell without incorporating a selectable transgene marker. A fertile plant can be produced from that plant cell that comprises an alteration at said one or more target sites, wherein the alteration is selected from the group consisting of (i) replacement of at least one nucleotide, (ii) a deletion of at least one nucleotide, (iii) an insertion of at least one nucleotide, and (iv) any combination of (i)-(iii). Plants comprising these altered target sites can be crossed with plants comprising at least one gene or trait of interest in the same complex trait locus, thereby further stacking traits in said complex trait locus. (see also US-2013-0263324-A1, published 3 Oct. 2013 and in PCT/US13/22891, published Jan. 24, 2013).

In one embodiment, the method comprises a method for producing in a plant a complex trait locus without incorporating a selectable transgene marker comprising at least two altered target sequences in a genomic region of interest, said method comprising: (a) selecting a genomic region in a plant, wherein the genomic region comprises a first target sequence and a second target sequence; (b) contacting at least one plant cell with at least a first guide polynucleotide, a second polynucleotide, and optionally at least one donor DNA, and a Cas endonuclease, wherein the first and second guide polynucleotide and the Cas endonuclease can form a complex that enables the Cas endonuclease to introduce a double strand break in at least a first and a second target sequence; (c) identifying a cell from (b) comprising a first alteration at the first target sequence and a second alteration at the second target sequence; and (d) recovering a first fertile plant from the cell of (c) said fertile plant comprising the first alteration and the second alteration, wherein the first alteration and the second alteration are physically linked.

In one embodiment, the method comprises a method for producing in a plant a complex trait locus without incorporating a selectable transgene marker comprising at least two altered target sequences in a genomic region of interest, said method comprising: (a) selecting a genomic region in a plant, wherein the genomic region comprises a first target sequence and a second target sequence; (b) contacting at least one plant cell with a first guide polynucleotide, a Cas endonuclease, and optionally a first donor DNA, wherein the first guide polynucleotide and the Cas endonuclease can form a complex that enables the Cas endonuclease to introduce a double strand break a first target sequence; (c) identifying a cell from (b) comprising a first alteration at the first target sequence; (d) recovering a first fertile plant from the cell of (c), said first fertile plant comprising the first alteration; (e) contacting at least one plant cell with a second guide polynucleotide, a Cas endonuclease and optionally a second Donor DNA; (f) identifying a cell from (e) comprising a second alteration at the second target sequence; (g) recovering a second fertile plant from the cell of (f), said second fertile plant comprising the second alteration; and, (h) obtaining a fertile progeny plant from the second fertile plant of (g), said fertile progeny plant comprising the first alteration and the second alteration, wherein the first alteration and the second alteration are physically linked.

The structural similarity between a given genomic region and the corresponding region of homology found on the donor DNA can be any degree of sequence identity that allows for homologous recombination to occur. For example, the amount of homology or sequence identity shared by the "region of homology" of the donor DNA and the "genomic region" of the plant genome can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination The region of homology on the donor DNA can have homology to any sequence flanking the target site. While in some embodiments the regions of homology share significant sequence homology to the genomic sequence immediately flanking the target site, it is recognized that the regions of homology can be designed to have sufficient homology to regions that may be further 5' or 3' to the target site. In still other embodiments, the regions of homology can also have homology with a fragment of the target site along with downstream genomic regions. In one embodiment, the first region of homology further comprises a first fragment of the target site and the second region of homology comprises a second fragment of the target site, wherein the first and second fragments are dissimilar.

As used herein, "homologous recombination" includes the exchange of DNA fragments between two DNA molecules at the sites of homology. The frequency of homologous recombination is influenced by a number of factors. Different organisms vary with respect to the amount of homologous recombination and the relative proportion of homologous to non-homologous recombination. Generally, the length of the region of homology affects the frequency of homologous recombination events: the longer the region of homology, the greater the frequency. The length of the homology region needed to observe homologous recombination is also species-variable. In many cases, at least 5 kb of homology has been utilized, but homologous recombination has been observed with as little as 25-50 bp of homology. See, for example, Singer et al., (1982) Cell 31:25-33; Shen and Huang, (1986) Genetics 112:441-57; Watt et al., (1985) Proc. Natl. Acad. Sci. USA 82:4768-72, Sugawara and Haber, (1992) Mol Cell Biol 12:563-75, Rubnitz and Subramani, (1984) Mol Cell Biol 4:2253-8; Ayares et al., (1986) Proc. Natl. Acad. Sci. USA 83:5199-203; Liskay et al., (1987) Genetics 115:161-7.

Homology-directed repair (HDR) is a mechanism in cells to repair double-stranded and single stranded DNA breaks. Homology-directed repair includes homologous recombination (HR) and single-strand annealing (SSA) (Lieber. 2010 Annu. Rev. Biochem. 79:181-211). The most common form of HDR is called homologous recombination (HR), which has the longest sequence homology requirements between the donor and acceptor DNA. Other forms of HDR include single-stranded annealing (SSA) and breakage-induced replication, and these require shorter sequence homology relative to HR. Homology-directed repair at nicks (single-stranded breaks) can occur via a mechanism distinct from HDR at double-strand breaks (Davis and Maizels. PNAS (0027-8424), 111 (10), p. E924-E932.

Alteration of the genome of a plant cell, for example, through homologous recombination (HR), is a powerful tool for genetic engineering. Despite the low frequency of homologous recombination in higher plants, there are a few examples of successful homologous recombination of plant endogenous genes. The parameters for homologous recombination in plants have primarily been investigated by rescuing introduced truncated selectable marker genes. In these experiments, the homologous DNA fragments were typically between 0.3 kb to 2 kb. Observed frequencies for homologous recombination were on the order of $10^{-4}$ to $10^{-5}$. See, for example, Halfter et al., (1992) Mol Gen Genet 231:186-93; Offringa et al., (1990) EMBO J 9:3077-84; Offringa et al., (1993) Proc. Natl. Acad. Sci. USA 90:7346-50; Paszkowski et al., (1988) EMBO J 7:4021-6; Hourda and Paszkowski, (1994) Mol Gen Genet 243:106-11; and Risseeuw et al., (1995) Plant J 7:109-19.

Homologous recombination has been demonstrated in insects. In Drosophila, Dray and Gloor found that as little as 3 kb of total template:target homology sufficed to copy a large non-homologous segment of DNA into the target with reasonable efficiency (Dray and Gloor, (1997) Genetics 147:689-99). Using FLP-mediated DNA integration at a target FRT in Drosophila, Golic et al., showed integration was approximately 10-fold more efficient when the donor and target shared 4.1 kb of homology as compared to 1.1 kb of homology (Golic et al., (1997) Nucleic Acids Res 25:3665). Data from Drosophila indicates that 2-4 kb of homology is sufficient for efficient targeting, but there is some evidence that much less homology may suffice, on the order of about 30 bp to about 100 bp (Nassif and Engels, (1993) Proc. Natl. Acad. Sci. USA 90:1262-6; Keeler and Gloor, (1997) Mol Cell Biol 17:627-34).

Homologous recombination has also been accomplished in other organisms. For example, at least 150-200 bp of homology was required for homologous recombination in the parasitic protozoan Leishmania (Papadopoulou and Dumas, (1997) Nucleic Acids Res 25:4278-86). In the filamentous fungus Aspergillus nidulans, gene replacement has been accomplished with as little as 50 bp flanking homology (Chaveroche et al., (2000) Nucleic Acids Res 28:e97). Targeted gene replacement has also been demonstrated in the ciliate Tetrahymena thermophila (Gaertig et al., (1994) Nucleic Acids Res 22:5391-8). In mammals, homologous recombination has been most successful in the mouse using pluripotent embryonic stem cell lines (ES) that can be grown in culture, transformed, selected and introduced into a mouse embryo. Embryos bearing inserted transgenic ES cells develop as genetically offspring. By interbreeding siblings, homozygous mice carrying the selected genes can be obtained. An overview of the process is provided in Watson et al., (1992) Recombinant DNA, 2nd Ed., (Scientific American Books distributed by WH Freeman & Co.); Capecchi, (1989) Trends Genet 5:70-6; and Bronson, (1994) J Biol Chem 269:27155-8. Homologous recombination in mammals other than mouse has been limited by the lack of stem cells capable of being transplanted to oocytes or developing embryos. However, McCreath et al., Nature 405:1066-9 (2000) reported successful homologous recombination in sheep by transformation and selection in primary embryo fibroblast cells.

Error-prone DNA repair mechanisms can produce mutations at double-strand break sites. The nonhomologous end-joining (NHEJ) pathways are the most common repair mechanism to bring the broken ends together (Bleuyard et al., (2006) DNA Repair 5:1-12). The structural integrity of chromosomes is typically preserved by the repair, but deletions, insertions, or other rearrangements are possible. The two ends of one double-strand break are the most prevalent substrates of NHEJ (Kirik et al., (2000) EMBO J 19:5562-6), however if two different double-strand breaks occur, the free ends from different breaks can be ligated and result in chromosomal deletions (Siebert and Puchta, (2002) Plant Cell 14:1121-31), or chromosomal translocations between different chromosomes (Pacher et al., (2007) Genetics 175: 21-9).

Episomal DNA molecules can also be ligated into the double-strand break, for example, integration of T-DNAs into chromosomal double-strand breaks (Chilton and Que, (2003) Plant Physiol 133:956-65; Salomon and Puchta, (1998) EMBO J 17:6086-95). Once the sequence around the double-strand breaks is altered, for example, by exonuclease activities involved in the maturation of double-strand breaks, gene conversion pathways can restore the original structure if a homologous sequence is available, such as a homologous chromosome in non-dividing somatic cells, or a sister chromatid after DNA replication (Molinier et al., (2004) Plant Cell 16:342-52). Ectopic and/or epigenic DNA sequences may also serve as a DNA repair template for homologous recombination (Puchta, (1999) Genetics 152: 1173-81).

Once a double-strand break is induced in the DNA, the cell's DNA repair mechanism is activated to repair the break. Error-prone DNA repair mechanisms can produce mutations at double-strand break sites. The most common repair mechanism to bring the broken ends together is the nonhomologous end-joining (NHEJ) pathway (Bleuyard et al., (2006) DNA Repair 5:1-12). The structural integrity of chromosomes is typically preserved by the repair, but deletions, insertions, or other rearrangements are possible (Siebert and Puchta, (2002) Plant Cell 14:1121-31; Pacher et al., (2007) Genetics 175:21-9).

Alternatively, the double-strand break can be repaired by homologous recombination between homologous DNA sequences. Once the sequence around the double-strand break is altered, for example, by exonuclease activities involved in the maturation of double-strand breaks, gene conversion pathways can restore the original structure if a homologous sequence is available, such as a homologous chromosome in non-dividing somatic cells, or a sister chromatid after DNA replication (Molinier et al., (2004) Plant Cell 16:342-52). Ectopic and/or epigenic DNA sequences may also serve as a DNA repair template for homologous recombination (Puchta, (1999) Genetics 152:1173-81).

DNA double-strand breaks appear to be an effective factor to stimulate homologous recombination pathways (Puchta et al., (1995) Plant Mol Biol 28:281-92; Tzfira and White, (2005) Trends Biotechnol 23:567-9; Puchta, (2005) J Exp Bot 56:1-14). Using DNA-breaking agents, a two- to ninefold increase of homologous recombination was observed between artificially constructed homologous DNA repeats in plants (Puchta et al., (1995) Plant Mol Biol 28:281-92). In maize protoplasts, experiments with linear DNA molecules demonstrated enhanced homologous recombination between plasmids (Lyznik et al., (1991) Mol Gen Genet 230:209-18).

In one embodiment provided herein, the method comprises contacting a plant cell with the donor DNA and the endonuclease. Once a double-strand break is introduced in the target site by the endonuclease, the first and second regions of homology of the donor DNA can undergo homologous recombination with their corresponding genomic regions of homology resulting in exchange of DNA between the donor and the genome. As such, the provided methods result in the integration of the polynucleotide of interest of the donor DNA into the double-strand break in the target site in the plant genome, thereby altering the original target site and producing an altered genomic target site.

The donor DNA may be introduced by any means known in the art. For example, a plant having a target site is provided. The donor DNA may be provided by any transformation method known in the art including, for example, Agrobacterium-mediated transformation or biolistic particle bombardment. The donor DNA may be present transiently in the cell or it could be introduced via a viral replicon. In the presence of the Cas endonuclease and the target site, the donor DNA is inserted into the transformed plant's genome.

Another approach uses protein engineering of existing homing endonucleases to alter their target specificities. Homing endonucleases, such as I-SceI or I-CreI, bind to and cleave relatively long DNA recognition sequences (18 bp and 22 bp, respectively). These sequences are predicted to naturally occur infrequently in a genome, typically only 1 or 2 sites/genome. The cleavage specificity of a homing endonuclease can be changed by rational design of amino acid substitutions at the DNA binding domain and/or combinatorial assembly and selection of mutated monomers (see, for example, Arnould et al., (2006) J Mol Biol 355:443-58; Ashworth et al., (2006) Nature 441:656-9; Doyon et al., (2006) J Am Chem Soc 128:2477-84; Rosen et al., (2006) Nucleic Acids Res 34:4791-800; and Smith et al., (2006) Nucleic Acids Res 34:e149; Lyznik et al., (2009) U.S. Patent Application Publication No. 20090133152A1; Smith et al., (2007) U.S. Patent Application Publication No. 20070117128A1). Engineered meganucleases have been demonstrated that can cleave cognate mutant sites without broadening their specificity. An artificial recognition site specific to the wild type yeast I-SceI homing nuclease was introduced in maize genome and mutations of the recognition sequence were detected in 1% of analyzed F1 plants when a transgenic I-SceI was introduced by crossing and activated by gene excision (Yang et al., (2009) Plant Mol Biol 70:669-79). More practically, the maize liguleless locus was targeted using an engineered single-chain endonuclease designed based on the I-CreI meganuclease sequence. Mutations of the selected liguleless locus recognition sequence were detected in 3% of the T0 transgenic plants when the designed homing nuclease was introduced by Agrobacterium-mediated transformation of immature embryos (Gao et al., (2010) Plant J 61:176-87).

Polynucleotides of interest are further described herein and are reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for genetic engineering will change accordingly.

Genome Editing Using the Guide RNA/Cas Endonuclease System

As described herein, the guide RNA/Cas endonuclease system can be used in combination with a co-delivered polynucleotide modification template to allow for editing of a genomic nucleotide sequence of interest. Also, as described herein, for each embodiment that uses a guide RNA/Cas endonuclease system, a similar guide polynucleotide/Cas endonuclease system can be deployed where the guide polynucleotide does not solely comprise ribonucleic acids but wherein the guide polynucleotide comprises a combination of RNA-DNA molecules or solely comprise DNA molecules.

While numerous double-strand break-making systems exist, their practical applications for gene editing may be restricted due to the relatively low frequency of induced double-strand breaks (DSBs). To date, many genome modification methods rely on the homologous recombination system. Homologous recombination (HR) can provide molecular means for finding genomic DNA sequences of interest and modifying them according to the experimental specifications. Homologous recombination takes place in plant somatic cells at low frequency. The process can be enhanced to a practical level for genome engineering by introducing double-strand breaks (DSBs) at selected endonuclease target sites. The challenge has been to efficiently make DSBs at genomic sites of interest since there is a bias in the directionality of information transfer between two interacting DNA molecules (the broken one acts as an acceptor of genetic information). Described herein is the use of a guide RNA/Cas system which provides flexible genome cleavage specificity and results in a high frequency of double-strand breaks at a DNA target site, thereby enabling efficient gene editing in a nucleotide sequence of interest, wherein the nucleotide sequence of interest to be edited can be located within or outside the target site recognized and cleaved by a Cas endonuclease.

A "modified nucleotide" or "edited nucleotide" refers to a nucleotide sequence of interest that comprises at least one alteration when compared to its non-modified nucleotide sequence. Such "alterations" include, for example: (i)

replacement of at least one nucleotide, (ii) a deletion of at least one nucleotide, (iii) an insertion of at least one nucleotide, or (iv) any combination of (i)-(iii).

The term "polynucleotide modification template" includes a polynucleotide that comprises at least one nucleotide modification when compared to the nucleotide sequence to be edited. A nucleotide modification can be at least one nucleotide substitution, addition or deletion. Optionally, the polynucleotide modification template can further comprise homologous nucleotide sequences flanking the at least one nucleotide modification, wherein the flanking homologous nucleotide sequences provide sufficient homology to the desired nucleotide sequence to be edited.

In one embodiment, the disclosure describes a method for editing a nucleotide sequence in the genome of a cell without incorporating a selectable transgene marker, the method comprising providing at least one guide RNA, at least one polynucleotide modification template, and at least one Cas endonuclease to a cell, wherein the Cas endonuclease is capable of introducing a double-strand break at a target sequence in the genome of said cell, wherein said polynucleotide modification template includes at least one nucleotide modification of said nucleotide sequence to be edited. Cells include, but are not limited to, human, animal, bacterial, fungal, insect, and plant cells as well as plants and seeds produced by the methods described herein. The nucleotide to be edited can be located within or outside a target site recognized and cleaved by a Cas endonuclease. In one embodiment, the at least one nucleotide modification is not a modification at a target site recognized and cleaved by a Cas endonuclease. In another embodiment, there are at least 1, 2, 3, 4, 5, 6, 7, 8, 9, 10, 11, 12, 13, 14, 15, 16, 17, 18, 19, 20, 21, 22, 23, 24, 25, 26, 27, 30, 40, 50, 100, 200, 300, 400, 500, 600, 700, 900 or 1000 nucleotides between the at least one nucleotide to be edited and the genomic target site.

In one embodiment, the method comprises a method for editing a second gene of a plant genome without introducing an exogenous selectable marker into said plant genome, the method comprising providing a first guide RNA, a first polynucleotide modification template, a second guide RNA, a second polynucleotide modification template, and a Cas endonuclease to a plant cell comprising a first endogenous gene that can be modified to confer herbicide resistance, wherein said first guide RNA and Cas endonuclease are capable of forming a complex that enables the Cas endonuclease to introduce a double strand break at a first target site (located in or near said first endogenous gene) in the genome of said plant cell, wherein said first polynucleotide modification template comprises at least one nucleotide modification of said first endogenous gene to render said endogenous gene capable of conferring herbicide resistance to a plant cell, wherein said second guide RNA and Cas endonuclease are capable of forming a complex that enables the Cas endonuclease to introduce a double strand break at a second target site (located at a different locus than said first endogenous gene) in the genome of said plant cell, wherein said second polynucleotide modification template comprises at least one nucleotide alteration when compared to the second gene to be edited.

In one embodiment of genome editing, editing of the endogenous enolpyruvylshikimate-3-phosphate synthase (EPSPS) gene is disclosed herein wherein, the polynucleotide modification template (EPSPS polynucleotide modification template) includes a partial fragment of the EPSPS gene (and therefore does not encode a fully functional EPSPS polypeptide by itself). The EPSPS polynucleotide modification template contained three point mutations that were responsible for the creation of the T1021/P106S (TIPS) double mutant (Funke, T et al., J. Biol. Chem. 2009, 284: 9854-9860), which provide glyphosate tolerance to transgenic plants expressing as EPSPS double mutant transgene.

As defined herein "Glyphosate" includes any herbicidally effective form of N-phosphonomethylglycine (including any salt thereof), other forms which result in the production of the glyphosate anion in plants and any other herbicides of the phosphonomethylglycine family.

Increased resistance to a herbicide is demonstrated when plants which display the increased resistance to a herbicide are subjected to the herbicide and a dose/response curve is shifted to the right when compared with that provided by an appropriate control plant. Such dose/response curves have "dose" plotted on the x-axis and "percentage injury", "herbicidal effect" etc. plotted on the y-axis. Plants which are substantially resistant to the herbicide exhibit few, if any, bleached, necrotic, lytic, chlorotic or other lesions and are not stunted, wilted or deformed when subjected to the herbicide at concentrations and rates which are typically employed by the agricultural community to kill weeds in the field. The terms resistance and tolerance may be used interchangeably.

FIG. 12 A, B shows a schematic representation of components used in the genome editing procedure. A maize optimized Cas endonuclease, a guide RNA and a polynucleotide modification template were provided to a plant cell. For example, as shown in FIG. 12 A, B, the polynucleotide modification template included three nucleotide modifications (indicated by arrows) when compared to the EPSPS genomic sequence to be edited. These three nucleotide modifications are referred to as TIPS mutations as these nucleotide modifications result in the amino acid changes T-102 to I-102 and P-106 to S-106. The first point mutation results from the substitution of the C nucleotide in the codon sequence ACT with a T nucleotide, a second mutation results from the substitution of the T nucleotide on the same codon sequence ACT with a C nucleotide to form the isoleucine codon ATC, the third point mutation results from the substitution of the first C nucleotide in the codon sequence CCA with a T nucleotide in order to form a serine codon TCA (FIG. 12 A, B).

The nucleotide sequence to be edited can be a sequence that is endogenous, artificial, pre-existing, or transgenic to the cell that is being edited. For example, the nucleotide sequence in the genome of a cell can be a native gene, a mutated gene, a non-native gene, a foreign gene, or a transgene that is stably incorporated into the genome of a cell. Editing of such nucleotide may result in a further desired phenotype or genotype.

Regulatory Sequence Modifications Using the Guide Polynucleotide/Cas Endonuclease System In one embodiment the nucleotide sequence to be modified can be a regulatory sequence such as a promoter wherein the editing of the promoter comprises replacing the promoter (also referred to as a "promoter swap" or "promoter replacement") or promoter fragment with a different promoter (also referred to as replacement promoter) or promoter fragment (also referred to as replacement promoter fragment), wherein the promoter replacement results in any one of the following or any one combination of the following: an increased promoter activity, an increased promoter tissue specificity, a decreased promoter activity, a decreased promoter tissue specificity, a new promoter activity, an inducible promoter activity, an extended window of gene expression, a modification of the timing or developmental progress of gene expression in the same cell layer or other cell layer (such as but not limiting to extending the timing of gene expression in the tapetum of maize anthers (U.S. Pat. No. 5,837,850 issued Nov. 17, 1998), a mutation of DNA binding elements and/or a deletion or addition of DNA binding elements. The promoter (or promoter fragment) to be modified can be a promoter (or promoter fragment) that is endogenous, artificial, pre-existing, or transgenic to the cell that is being edited. The replacement promoter (or replacement promoter fragment) can be a promoter (or promoter fragment) that is endogenous, artificial, pre-existing, or transgenic to the cell that is being edited.

In one embodiment the nucleotide sequence can be a promoter wherein the editing of the promoter comprises replacing a native EPSPS1 promoter from with a plant ubiquitin promoter.

In one embodiment the nucleotide sequence can be a promoter wherein the promoter to be edited is selected from the group comprising *Zea mays*-PEPC1 promoter (Kausch et al, Plant Molecular Biology, 45: 1-15, 2001), *Zea mays* Ubiquitin promoter (UB11ZM PRO, Christensen et al, plant Molecular Biology 18: 675-689, 1992), *Zea mays*-Rootmet2 promoter (U.S. Pat. No. 7,214,855), Rice actin promoter (OS-ACTIN PRO, U.S. Pat. No. 5,641,876; McElroy et al, The Plant Cell, Vol 2, 163-171, February 1990), Sorghum RCC3 promoter (US 2012/0210463 filed on 13 Feb. 2012), *Zea mays*-GOS2 promoter (U.S. Pat. No. 6,504,083), *Zea mays*-ACO2 promoter (U.S. application Ser. No. 14/210,711 filed 14 Mar. 2014) or *Zea mays*-oleosin promoter (U.S. Pat. No. 8,466,341 B2).

In one embodiment, the guide polynucleotide/Cas endonuclease system can be used in combination with a co-delivered polynucleotide modification template or donor DNA sequence to allow for the insertion of a promoter or promoter element into a genomic nucleotide sequence of interest without incorporating a selectable transgene marker, wherein the promoter insertion (or promoter element insertion) results in any one of the following or any one combination of the following: an increased promoter activity (increased promoter strength), an increased promoter tissue specificity, a decreased promoter activity, a decreased promoter tissue specificity, a new promoter activity, an inducible promoter activity, an extended window of gene expression, a modification of the timing or developmental progress of gene expression, a mutation of DNA binding elements and/or an addition of DNA binding elements. Promoter elements to be inserted can be, but are not limited to, promoter core elements (such as, but not limited to, a CAAT box, a CCAAT box, a Pribnow box, a and/or TATA box, translational regulation sequences and/or a repressor system for inducible expression (such as TET operator repressor/operator/inducer elements, or sulphonylurea (Su) repressor/operator/inducer elements. The dehydration-responsive element (DRE) was first identified as a cis-acting promoter element in the promoter of the drought-responsive gene rd29A, which contains a 9 bp conserved core sequence, TACCGACAT (Yamaguchi-Shinozaki, K., and Shinozaki, K. (1994) *Plant Cell* 6, 251-264). Insertion of DRE into an endogenous promoter may confer a drought inducible expression of the downstream gene. Another example is ABA-responsive elements (ABREs) which contains a (C/T) ACGTGGC consensus sequence found to be present in numerous ABA and/or stress-regulated genes (Busk P. K., Pages M. (1998) Plant Mol. Biol. 37:425-435). Insertion of 35S enhancer or MMV enhancer into an endogenous promoter region will increase gene expression (U.S. Pat. No. 5,196,525). The promoter (or promoter element) to be inserted can be a promoter (or promoter element) that is endogenous, artificial, pre-existing, or transgenic to the cell that is being edited.

In one embodiment, the guide polynucleotide/Cas endonuclease system can be used to insert an enhancer element, such as but not limited to a Cauliflower Mosaic Virus 35 S enhancer, in front of an endogenous FMT1 promoter to enhance expression of the FTM1.

In one embodiment, the guide polynucleotide/Cas endonuclease system can be used to insert a component of the TET operator repressor/operator/inducer system, or a component of the sulphonylurea (Su) repressor/operator/inducer system into plant genomes to generate or control inducible expression systems without incorporating a selectable transgene marker.

In another embodiment, the guide polynucleotide/Cas endonuclease system can be used to allow for the deletion of a promoter or promoter element, wherein the promoter deletion (or promoter element deletion) results in any one of the following or any one combination of the following: a permanently inactivated gene locus, an increased promoter activity (increased promoter strength), an increased promoter tissue specificity, a decreased promoter activity, a decreased promoter tissue specificity, a new promoter activity, an inducible promoter activity, an extended window of gene expression, a modification of the timing or developmental progress of gene expression, a mutation of DNA binding elements and/or an addition of DNA binding elements. Promoter elements to be deleted can be, but are not limited to, promoter core elements, promoter enhancer elements or 35 S enhancer elements (as described in Example 32) The promoter or promoter fragment to be deleted can be endogenous, artificial, pre-existing, or transgenic to the cell that is being edited.

Terminator Modifications Using the Guide Polynucleotide/Cas Endonuclease System

In one embodiment the nucleotide sequence to be modified can be a terminator wherein the editing of the terminator comprises replacing the terminator (also referred to as a "terminator swap" or "terminator replacement") or terminator fragment with a different terminator (also referred to as replacement terminator) or terminator fragment (also referred to as replacement terminator fragment), wherein the terminator replacement results in any one of the following or any one combination of the following: an increased terminator activity, an increased terminator tissue specificity, a decreased terminator activity, a decreased terminator tissue specificity, a mutation of DNA binding elements and/or a deletion or addition of DNA binding elements." The terminator (or terminator fragment) to be modified can be a terminator (or terminator fragment) that is endogenous, artificial, pre-existing, or transgenic to the cell that is being edited. The replacement terminator (or replacement terminator fragment) can be a terminator (or terminator fragment) that is endogenous, artificial, pre-existing, or transgenic to the cell that is being edited.

In one embodiment the nucleotide sequence to be modified can be a terminator wherein the terminator to be edited is selected from the group comprising terminators from maize Argos 8 or SRTF18 genes, or other terminators, such as potato PinII terminator, sorghum actin terminator (SB-ACTIN TERM, WO 2013/184537 A1 published December 2013), sorghum SB-GKAF TERM (WO2013019461), rice T28 terminator (OS-T28 TERM, WO 2013/012729 A2), AT-T9 TERM (WO 2013/012729 A2) or GZ-W64A TERM (U.S. Pat. No. 7,053,282).

In one embodiment, the guide polynucleotide/Cas endonuclease system can be used in combination with a co-delivered polynucleotide modification template or donor DNA sequence to allow for the insertion of a terminator or terminator element into a genomic nucleotide sequence of interest, wherein the terminator insertion (or terminator element insertion) results in any one of the following or any one combination of the following: an increased terminator activity (increased terminator strength), an increased terminator tissue specificity, a decreased terminator activity, a decreased terminator tissue specificity, a mutation of DNA binding elements and/or an addition of DNA binding elements.

The terminator (or terminator element) to be inserted can be a terminator (or terminator element) that is endogenous, artificial, pre-existing, or transgenic to the cell that is being edited.

In another embodiment, the guide polynucleotide/Cas endonuclease system can be used to allow for the deletion of a terminator or terminator element, wherein the terminator deletion (or terminator element deletion) results in any one of the following or any one combination of the following: an increased terminator activity (increased terminator strength), an increased terminator tissue specificity, a decreased terminator activity, a decreased terminator tissue specificity, a mutation of DNA binding elements and/or an addition of DNA binding elements. The terminator or terminator fragment to be deleted can be endogenous, artificial, pre-existing, or transgenic to the cell that is being edited.

Additional Regulatory Sequence Modifications Using the Guide Polynucleotide/Cas Endonuclease System In one embodiment, the guide polynucleotide/Cas endonuclease system can be used to modify or replace a regulatory sequence in the genome of a cell without incorporating a selectable transgene marker. A regulatory sequence is a segment of a nucleic acid molecule which is capable of increasing or decreasing the expression of specific genes within an organism and/or is capable of altering tissue specific expression of genes within an organism. Examples of regulatory sequences include, but are not limited to, 3' UTR (untranslated region) region, 5' UTR region, transcription activators, transcriptional enhancers transcriptions repressors, translational repressors, splicing factors, miRNAs, siRNA, artificial miRNAs, promoter elements, CAMV 35 S enhancer, MMV enhancer elements (PCT/US14/23451 filed Mar. 11, 2013), SECIS elements, polyadenylation signals, and polyubiquitination sites. In some embodiments the editing (modification) or replacement of a regulatory element results in altered protein translation, RNA cleavage, RNA splicing, transcriptional termination or post translational modification. In one embodiment, regulatory elements can be identified within a promoter and these regulatory elements can be edited or modified do to optimize these regulatory elements for up or down regulation of the promoter.

In one embodiment, the genomic sequence of interest to be modified is a polyubiquitination site, wherein the modification of the polyubiquitination sites results in a modified rate of protein degradation. The ubiquitin tag condemns proteins to be degraded by proteasomes or autophagy. Proteasome inhibitors are known to cause a protein overproduction. Modifications made to a DNA sequence encoding a protein of interest can result in at least one amino acid modification of the protein of interest, wherein said modification allows for the polyubiquitination of the protein (a post translational modification) resulting in a modification of the protein degradation In one embodiment, the genomic sequence of interest to be modified is a polyubiquitination site on a maize EPSPS gene, wherein the polyubiquitination site modified resulting in an increased protein content due to a slower rate of EPSPS protein degradation.

In one embodiment, the genomic sequence of interest to be modified is a an intron site, wherein the modification consist of inserting an intron enhancing motif into the intron which results in modulation of the transcriptional activity of the gene comprising said intron.

In one embodiment, the genomic sequence of interest to be modified is a an intron site, wherein the modification consist of replacing a soybean EPSP1 intron with a soybean ubiquitin intron 1 as described herein (Example 25)

In one embodiment, the genomic sequence of interest to be modified is a an intron or UTR site, wherein the modification consist of inserting at least one microRNA into said intron or UTR site, wherein expression of the gene comprising the intron or UTR site also results in expression of said microRNA, which in turn can silence any gene targeted by the microRNA without disrupting the gene expression of the native/transgene comprising said intron.

In one embodiment, the guide polynucleotide/Cas endonuclease system can be used to allow for the deletion or mutation of a Zinc Finger transcription factor, wherein the deletion or mutation of the Zinc Finger transcription factor results in or allows for the creation of a dominant negative Zinc Finger transcription factor mutant (Li et al 2013 Rice zinc finger protein DST enhances grain production through controlling Gn1a/OsCKX2 expression PNAS 110:3167-3172). Insertion of a single base pair downstream zinc finger domain will result in a frame shift and produces a new protein which still can bind to DNA without transcription activity. The mutant protein will compete to bind to cytokinin oxidase gene promoters and block the expression of cytokinin oxidase gene. Reduction of cytokinin oxidase gene expression will increase cytokinin level and promote panicle growth in rice and ear growth in maize, and increase yield under normal and stress conditions.

Modifications of Splicing Sites and/or Introducing Alternate Splicing Sites Using the Guide Polynucleotide/Cas Endonuclease System Protein synthesis utilizes mRNA molecules that emerge from pre-mRNA molecules subjected to the maturation process. The pre-mRNA molecules are capped, spliced and stabilized by addition of polyA tails. Eukaryotic cells developed a complex process of splicing that result in alternative variants of the original pre-mRNA molecules. Some of them may not produce functional templates for protein synthesis. In maize cells, the splicing process is affected by splicing sites at the exon-intron junction sites. An example of a canonical splice site is AGGT. Gene coding sequences can contains a number of alternate splicing sites that may affect the overall efficiency of the pre-mRNA maturation process and as such may limit the protein accumulation in cells. The guide polynucleotide/Cas endonuclease system can be used in combination with a co-delivered polynucleotide modification template to edit a gene of interest to introduce a canonical splice site at a described junction or any variant of a splicing site that changes the splicing pattern of pre-mRNA molecules, without incorporating a selectable transgene marker.

In one embodiment, the nucleotide sequence of interest to be modified is a maize EPSPS gene, wherein the modification of the gene consists of modifying alternative splicing sites resulting in enhanced production of the functional gene transcripts and gene products (proteins).

In one embodiment, the nucleotide sequence of interest to be modified is a gene, wherein the modification of the gene consists of editing the intron borders of alternatively spliced genes to alter the accumulation of splice variants.

Modifications of Nucleotide Sequences Encoding a Protein of Interest Using the Guide polynucleotide/Cas endonuclease system In one embodiment, the guide polynucleotide/Cas endonuclease system can be used to modify or replace a coding sequence in the genome of a cell without incorporating a selectable transgene marker, wherein the modification or replacement results in any one of the following, or any one combination of the following: an increased protein (enzyme) activity, an increased protein functionality, a decreased protein activity, a decreased protein functionality, a site specific mutation, a protein domain swap, a protein knockout, a new protein functionality, a modified protein functionality.

In one embodiment the protein knockout is due to the introduction of a stop codon into the coding sequence of interest.

In one embodiment the protein knockout is due to the deletion of a start codon into the coding sequence of interest.

Amino Acid and/or Protein Fusions Using the Guide Polynucleotide/Cas Endonuclease System In one embodiment, the guide polynucleotide/Cas endonuclease system can be used with or without a co-delivered polynucleotide sequence to fuse a first coding sequence encoding a first protein to a second coding sequence encoding a second protein in the genome of a cell, without incorporating a selectable transgene marker, wherein the protein fusion results in any one of the following or any one combination of the following: an increased protein (enzyme) activity, an increased protein functionality, a decreased protein activity, a decreased protein functionality, a new protein functionality, a modified protein functionality, a new protein localization, a new timing of protein expression, a modified protein expression pattern, a chimeric protein, or a modified protein with dominant phenotype functionality.

In one embodiment, the guide polynucleotide/Cas endonuclease system can be used with or without a co-delivered polynucleotide sequence to fuse a first coding sequence encoding a chloroplast localization signal to a second coding sequence encoding a protein of interest, wherein the protein fusion results in targeting the protein of interest to the chloroplast.

In one embodiment, the guide polynucleotide/Cas endonuclease system can be used with or without a co-delivered polynucleotide sequence to fuse a first coding sequence encoding a chloroplast localization signal to a second coding sequence encoding a protein of interest, wherein the protein fusion results in targeting the protein of interest to the chloroplast.

In one embodiment, the guide polynucleotide/Cas endonuclease system can be used with or without a co-delivered polynucleotide sequence to fuse a first coding sequence encoding a chloroplast localization signal (e.g., a chloroplast transit peptide) to a second coding sequence, wherein the protein fusion results in a modified protein with dominant phenotype functionality Gene Silencing by Expressing an Inverted Repeat into a Gene of Interest Using the Guide Polynucleotide/Cas Endonuclease System In one embodiment, the guide polynucleotide/Cas endonuclease system can be used in combination with a co-delivered polynucleotide sequence to insert an inverted gene fragment into a gene of interest in the genome of an organism, without incorporating a selectable transgene marker, wherein the insertion of the inverted gene fragment can allow for an in-vivo creation of an inverted repeat (hairpin) and results in the silencing of said endogenous gene.

In one embodiment the insertion of the inverted gene fragment can result in the formation of an in-vivo created inverted repeat (hairpin) in a native (or modified) promoter of a gene and/or in a native 5' end of the native gene. The inverted gene fragment can further comprise an intron which can result in an enhanced silencing of the targeted gene.

Genome Deletion for Trait Locus Characterization

Trait mapping in plant breeding often results in the detection of chromosomal regions housing one or more genes controlling expression of a trait of interest. For a qualitative trait, the guide polynucleotide/Cas endonuclease system can be used to eliminate candidate genes in the identified chromosomal regions to determine if deletion of the gene affects expression of the trait. For quantitative traits, expression of a trait of interest is governed by multiple quantitative trait loci (QTL) of varying effect-size, complexity, and statistical significance across one or more chromosomes. In cases of negative effect or deleterious QTL regions affecting a complex trait, the guide polynucleotide/Cas endonuclease system can be used to eliminate whole regions delimited by marker-assisted fine mapping, and to target specific regions for their selective elimination or rearrangement. Similarly, presence/absence variation (PAV) or copy number variation (CNV) can be manipulated with selective genome deletion using the guide polynucleotide/Cas endonuclease system.

In one embodiment, the region of interest can be flanked by two independent guide polynucleotide/CAS endonuclease target sequences. Cutting would be done concurrently. The deletion event would be the repair of the two chromosomal ends without the region of interest. Alternative results would include inversions of the region of interest, mutations at the cut sites and duplication of the region of interest.

Methods for Identifying at Least One Plant Cell Comprising in its Genome a Polynucleotide of Interest Integrated at the Target Site.

Further provided are methods for identifying at least one plant cell comprising in its genome a polynucleotide of Interest integrated at the target site. A variety of methods are available for identifying those plant cells with insertion into the genome at or near to the target site without using a screenable marker phenotype. Such methods can be viewed as directly analyzing a target sequence to detect any change in the target sequence, including but not limited to PCR methods, sequencing methods, nuclease digestion, Southern blots, and any combination thereof. See, for example, U.S. patent application Ser. No. 12/147,834, herein incorporated by reference to the extent necessary for the methods described herein. The method also comprises recovering a plant from the plant cell comprising a polynucleotide of Interest integrated into its genome. The plant may be sterile or fertile. It is recognized that any polynucleotide of interest can be provided, integrated into the plant genome at the target site, and expressed in a plant.

Polynucleotides/polypeptides of interest include, but are not limited to, herbicide-resistance coding sequences, insecticidal coding sequences, nematicidal coding sequences, antimicrobial coding sequences, antifungal coding sequences, antiviral coding sequences, abiotic and biotic stress tolerance coding sequences, or sequences modifying plant traits such as yield, grain quality, nutrient content, starch quality and quantity, nitrogen fixation and/or utilization, fatty acids, and oil content and/or composition. More specific polynucleotides of interest include, but are not limited to, genes that improve crop yield, polypeptides that improve desirability of crops, genes encoding proteins conferring resistance to abiotic stress, such as drought, nitrogen, temperature, salinity, toxic metals or trace elements, or those conferring resistance to toxins such as pesticides and herbicides, or to biotic stress, such as attacks by fungi, viruses, bacteria, insects, and nematodes, and development of diseases associated with these organisms. General categories of genes of interest include, for example, those genes involved in information, such as zinc fingers, those involved in communication, such as kinases, and those involved in housekeeping, such as heat shock proteins. More specific categories of transgenes, for example, include genes encoding important traits for agronomics, insect resistance, disease resistance, herbicide resistance, fertility or sterility, grain characteristics, and commercial products. Genes of interest include, generally, those involved in oil, starch, carbohydrate, or nutrient metabolism as well as those affecting kernel size, sucrose loading, and the like that can be stacked or used in combination with glyphosate resistance described herein.

The terms "FAD" and fatty acid desaturase are used interchangeably and refer to membrane bound microsomal oleoyl- and linoleoyl-phosphatidylcholine desaturases that convert oleic acid to linoleic acid and linoleic acid to linolenic acid, respectively, in reactions that reduce molecular oxygen to water and require the presence of NADH. The gene for microsomal delta 12 fatty acid desaturases described in WO 94/11516, can be used to make a high oleic acid soybean variety. The resulting high oleic acid soybean variety was one in which the polyunsaturated fatty acids were reduced from 70% of the total fatty acids to less than 5%.

Plant having a high oleic phenotype (a high oleic acid phenotype) and a herbicide tolerance phenotype conferred by suppression of a FAD2 gene in conjunction with the expression of a sequence that confers tolerance to inhibitors of ALS have been described in U.S. Pat. No. 8,609,935, issued 2013 Dec. 17)

Two soybean fatty acid desaturases, designated FAD2-1 and FAD2-2, are A 12 desaturases that introduce a second double bond into oleic acid to form linoleic acid, a polyunsaturated fatty acid. FAD2-1 is expressed only in the developing seed (Heppard et al. (1996) Plant Physiol. 110:311-319). The expression of this gene increases during the period of oil deposition, starting around 19 days after flowering, and its gene product is responsible for the synthesis of the polyunsaturated fatty acids found in soybean oil. GmFad 2-1 is described in detail by Okuley, J. et al. (1994) Plant Cell 6:147 158 and in WO94/11516. It is available from the ATCC in the form of plasmid pSF2 169K (ATCC accession number 69092). FAD 2-2 is expressed in the seed, leaf, root and stem of the soy plant at a constant level and is the "housekeeping" 12-desaturase gene. The Fad 2-2 gene product is responsible for the synthesis of polyunsaturated fatty acids for cell membranes. Since FAD2-1 is the major enzyme of this type in soybean seeds, reduction in the expression of FAD2-1 results in increased accumulation of oleic acid (18:1) and a corresponding decrease in polyunsaturated fatty acid content. Reduction of expression of FAD2-2 in combination with FAD2-1 leads to a greater accumulation of oleic acid and corresponding decrease in polyunsaturated fatty acid content. FAD3 is a $\Delta$ 15 desaturase that introduces a third double bond into linoleic acid (18:2) to form linolenic acid (18:3). Reduction of expression of FAD3 in combination with reduction of FAD2-1 and FAD2-2 leads to a greater accumulation of oleic acid and corresponding decrease in polyunsaturated fatty acid content, especially linolenic acid.

Nucleic acid fragments encoding FAD2-1, FAD2-2, and FAD3 have been described in WO 94/11516 and WO 93/11245. Chimeric recombinant constructs comprising all or a part of these nucleic acid fragments or the reverse complements thereof operably linked to at least one suitable regulatory sequence can be constructed wherein expression of the chimeric gene results in an altered fatty acid phenotype. A chimeric recombinant construct can be introduced into soybean plants via transformation techniques well known to those skilled in the art. Transgenic soybean plants resulting from a transformation with a recombinant DNA are assayed to select plants with altered fatty acid profiles. The recombinant construct may contain all or part of 1) the FAD2-1 gene or 2) the FAD2-2 gene or 3) the FAD3 gene or 4) combinations of all or portions of the FAD2-1, Fad2-2, or FAD3 genes.

Recombinant constructs comprising all or part of 1) the FAD2-1 gene with or without 2) all or part of the Fad2-2 gene with or without all or part of the FAD3 gene can be used in making a transgenic soybean plant having a high oleic phenotype. An altered fatty acid profile, specifically an increase in the proportion of oleic acid and a decrease in the proportion of the polyunsaturated fatty acids, indicates that one or more of the soybean seed FAD genes (FAD2-1, Fad2-2, FAD3) have been suppressed. Assays may be conducted on soybean somatic embryo cultures and seeds to determine suppression of FAD2-1, Fad2-2, or FAD3.

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson et al. (1987) *Eur. J. Biochem.* 165:99-106, the disclosures of which are herein incorporated by reference.

Commercial traits can also be encoded on a polynucleotide of interest that could increase for example, starch for ethanol production, or provide expression of proteins. Another important commercial use of transformed plants is the production of polymers and bioplastics such as described in U.S. Pat. No. 5,602,321. Genes such as β-Ketothiolase, PHBase (polyhydroxybutyrate synthase), and acetoacetyl-CoA reductase (see Schubert et al. (1988) J. Bacteriol. 170:5837-5847) facilitate expression of polyhydroxyalkanoates (PHAs).

Derivatives of the coding sequences can be made by site-directed mutagenesis to increase the level of preselected amino acids in the encoded polypeptide. For example, the gene encoding the barley high lysine polypeptide (BHL) is derived from barley chymotrypsin inhibitor, U.S. application Ser. No. 08/740,682, filed Nov. 1, 1996, and WO 98/20133, the disclosures of which are herein incorporated by reference. Other proteins include methionine-rich plant proteins such as from sunflower seed (Lilley et al. (1989) *Proceedings of the World Congress on Vegetable Protein Utilization in Human Foods and Animal Feedstuffs*, ed.

Applewhite (American Oil Chemists Society, Champaign, Illinois), pp. 497-502; herein incorporated by reference); corn (Pedersen et al. (1986) *J. Biol. Chem.* 261:6279; Kirihara et al. (1988) *Gene* 71:359; both of which are herein incorporated by reference); and rice (Musumura et al. (1989) *Plant Mol. Biol.* 12:123, herein incorporated by reference). Other agronomically important genes encode latex, Floury 2, growth factors, seed storage factors, and transcription factors.

Polynucleotides that improve crop yield include dwarfing genes, such as Rht1 and Rht2 (Peng et al. (1999) Nature 400:256-261), and those that increase plant growth, such as ammonium-inducible glutamate dehydrogenase. Polynucleotides that improve desirability of crops include, for example, those that allow plants to have reduced saturated fat content, those that boost the nutritional value of plants, and those that increase grain protein. Polynucleotides that improve salt tolerance are those that increase or allow plant growth in an environment of higher salinity than the native environment of the plant into which the salt-tolerant gene(s) has been introduced.

Polynucleotides/polypeptides that influence amino acid biosynthesis include, for example, anthranilate synthase (AS; EC 4.1.3.27) which catalyzes the first reaction branching from the aromatic amino acid pathway to the biosynthesis of tryptophan in plants, fungi, and bacteria. In plants, the chemical processes for the biosynthesis of tryptophan are compartmentalized in the chloroplast. See, for example, US Pub. 20080050506, herein incorporated by reference. Additional sequences of interest include Chorismate Pyruvate Lyase (CPL) which includes a gene encoding an enzyme which catalyzes the conversion of chorismate to pyruvate and pHBA. The most well characterized CPL gene has been isolated from *E. coli* and bears the GenBank accession number M96268. See, U.S. Pat. No. 7,361,811, herein incorporated by reference.

Polynucleotide sequences of interest may encode proteins involved in providing disease or pest resistance. By "disease resistance" or "pest resistance" is intended that the plants avoid the harmful symptoms that are the outcome of the plant-pathogen interactions. Pest resistance genes may encode resistance to pests that have great yield drag such as rootworm, cutworm, European Corn Borer, and the like. Disease resistance and insect resistance genes such as lysozymes or cecropins for antibacterial protection, or proteins such as defensins, glucanases or chitinases for antifungal protection, or *Bacillus thuringiensis* endotoxins, protease inhibitors, collagenases, lectins, or glycosidases for controlling nematodes or insects are all examples of useful gene products. Genes encoding disease resistance traits include detoxification genes, such as against fumonisin (U.S. Pat. No. 5,792,931); avirulence (avr) and disease resistance (R) genes (Jones et al. (1994) Science 266:789; Martin et al. (1993) Science 262:1432; and Mindrinos et al. (1994) Cell 78:1089); and the like. Insect resistance genes may encode resistance to pests that have great yield drag such as rootworm, cutworm, European Corn Borer, and the like. Such genes include, for example, *Bacillus thuringiensis* toxic protein genes (U.S. Pat. Nos. 5,366,892; 5,747,450; 5,736,514; 5,723,756; 5,593,881; and Geiser et al. (1986) *Gene* 48:109); and the like.

An "herbicide resistance protein" or a protein resulting from expression of an "herbicide resistance-encoding nucleic acid molecule" includes proteins that confer upon a cell the ability to tolerate a higher concentration of an herbicide than cells that do not express the protein, or to tolerate a certain concentration of an herbicide for a longer period of time than cells that do not express the protein. Herbicide resistance traits may be introduced into plants by genes coding for resistance to herbicides that act to inhibit the action of acetolactate synthase (ALS), in particular the sulfonylurea-type herbicides, genes coding for resistance to herbicides that act to inhibit the action of glutamine synthase, such as phosphinothricin or basta (e.g., the bar gene), glyphosate (e.g., the EPSP synthase gene and the GAT gene), HPPD inhibitors (e.g, the HPPD gene) or other such genes known in the art. See, for example, U.S. Pat. Nos. 7,626,077, 5,310,667, 5,866,775, 6,225,114, 6,248,876, 7,169,970, 6,867,293, and U.S. Provisional Application No. 61/401,456, each of which is herein incorporated by reference. The bar gene encodes resistance to the herbicide basta, the nptII gene encodes resistance to the antibiotics kanamycin and geneticin, and the ALS-gene mutants encode resistance to the herbicide chlorsulfuron.

Sterility genes can also be encoded in an expression cassette and provide an alternative to physical detasseling. Examples of genes used in such ways include male fertility genes such as MS26 (see for example U.S. Pat. Nos. 7,098,388, 7,517,975, 7,612,251), MS45 (see for example U.S. Pat. Nos. 5,478,369, 6,265,640) or MSCA1 (see for example U.S. Pat. No. 7,919,676). Maize plants (*Zea mays* L.) can be bred by both self-pollination and cross-pollination techniques. Maize has male flowers, located on the tassel, and female flowers, located on the ear, on the same plant. It can self-pollinate ("selfing") or cross pollinate. Natural pollination occurs in maize when wind blows pollen from the tassels to the silks that protrude from the tops of the incipient ears. Pollination may be readily controlled by techniques known to those of skill in the art. The development of maize hybrids requires the development of homozygous inbred lines, the crossing of these lines, and the evaluation of the crosses. Pedigree breeding and recurrent selections are two of the breeding methods used to develop inbred lines from populations. Breeding programs combine desirable traits from two or more inbred lines or various broad-based sources into breeding pools from which new inbred lines are developed by selfing and selection of desired phenotypes. A hybrid maize variety is the cross of two such inbred lines, each of which may have one or more desirable characteristics lacked by the other or which complement the other. The new inbreds are crossed with other inbred lines and the hybrids from these crosses are evaluated to determine which have commercial potential. The hybrid progeny of the first generation is designated F1. The F1 hybrid is more vigorous than its inbred parents. This hybrid vigor, or heterosis, can be manifested in many ways, including increased vegetative growth and increased yield.

Hybrid maize seed can be produced by a male sterility system incorporating manual detasseling. To produce hybrid seed, the male tassel is removed from the growing female inbred parent, which can be planted in various alternating row patterns with the male inbred parent. Consequently, providing that there is sufficient isolation from sources of foreign maize pollen, the ears of the female inbred will be fertilized only with pollen from the male inbred. The resulting seed is therefore hybrid (F1) and will form hybrid plants.

Field variation impacting plant development can result in plants tasseling after manual detasseling of the female parent is completed. Or, a female inbred plant tassel may not be completely removed during the detasseling process. In any event, the result is that the female plant will successfully shed pollen and some female plants will be self-pollinated. This will result in seed of the female inbred being harvested along with the hybrid seed which is normally produced.

Female inbred seed does not exhibit heterosis and therefore is not as productive as F1 seed. In addition, the presence of female inbred seed can represent a germplasm security risk for the company producing the hybrid.

Alternatively, the female inbred can be mechanically detasseled by machine. Mechanical detasseling is approximately as reliable as hand detasseling, but is faster and less costly. However, most detasseling machines produce more damage to the plants than hand detasseling. Thus, no form of detasseling is presently entirely satisfactory, and a need continues to exist for alternatives which further reduce production costs and to eliminate self-pollination of the female parent in the production of hybrid seed.

Mutations that cause male sterility in plants have the potential to be useful in methods for hybrid seed production for crop plants such as maize and can lower production costs by eliminating the need for the labor-intensive removal of male flowers (also known as de-tasseling) from the maternal parent plants used as a hybrid parent. Mutations that cause male sterility in maize have been produced by a variety of methods such as X-rays or UV-irradiations, chemical treatments, or transposable element insertions (ms23, ms25, ms26, ms32) (Chaubal et al. (2000) Am J Bot 87:1193-1201). Conditional regulation of fertility genes through fertility/sterility "molecular switches" could enhance the options for designing new male-sterility systems for crop improvement (Unger et al. (2002) *Transgenic Res* 11:455-465).

Besides identification of novel genes impacting male fertility, there remains a need to provide a reliable system of producing genetic male sterility.

In U.S. Pat. No. 5,478,369, a method is described by which the Ms45 male fertility gene was tagged and cloned on maize chromosome 9. Previously, there had been described a male fertility gene on chromosome 9, ms2, which had never been cloned and sequenced. It is not allelic to the gene referred to in the '369 patent. See Albertsen, M. and Phillips, R. L., "Developmental Cytology of 13 Genetic Male Sterile Loci in Maize" Canadian Journal of Genetics & Cytology 23:195-208 (January 1981). The only fertility gene cloned before that had been the *Arabidopsis* gene described at Aarts, et al., supra.

Examples of genes that have been discovered subsequently that are important to male fertility are numerous and include the *Arabidopsis* ABORTED MICROSPORES (AMS) gene, Sorensen et al., The Plant Journal (2003) 33(2):413-423); the *Arabidopsis* MS1 gene (Wilson et al., The Plant Journal (2001) 39(2):170-181); the NEF1 gene (Ariizumi et al., The Plant Journal (2004) 39(2):170-181); *Arabidopsis* AtGPAT1 gene (Zheng et al., The Plant Cell (2003) 15:1872-1887); the *Arabidopsis* dde2-2 mutation was shown to be defective in the allene oxide syntase gene (Malek et al., Planta (2002)216:187-192); the *Arabidopsis* faceless pollen-1 gene (flp1) (Ariizumi et al, Plant Mol. Biol. (2003) 53:107-116); the *Arabidopsis* MALE MEIOCYTE DEATH1 gene (Yang et al., The Plant Cell (2003) 15: 1281-1295); the tapetum-specific zinc finger gene, TAZ1 (Kapoor et al., The Plant Cell (2002) 14:2353-2367); and the TAPETUM DETERMINANT1 gene (Lan et al, The Plant Cell (2003) 15:2792-2804).

Other known male fertility mutants or genes from *Zea mays* are listed in U.S. Pat. No. 7,919,676 incorporated herein by reference.

Other genes include kinases and those encoding compounds toxic to either male or female gametophytic development.

Furthermore, it is recognized that the polynucleotide of interest may also comprise antisense sequences complementary to at least a portion of the messenger RNA (mRNA) for a targeted gene sequence of interest. Antisense nucleotides are constructed to hybridize with the corresponding mRNA. Modifications of the antisense sequences may be made as long as the sequences hybridize to and interfere with expression of the corresponding mRNA. In this manner, antisense constructions having 70%, 80%, or 85% sequence identity to the corresponding antisense sequences may be used. Furthermore, portions of the antisense nucleotides may be used to disrupt the expression of the target gene. Generally, sequences of at least 50 nucleotides, 100 nucleotides, 200 nucleotides, or greater may be used.

In addition, the polynucleotide of interest may also be used in the sense orientation to suppress the expression of endogenous genes in plants. Methods for suppressing gene expression in plants using polynucleotides in the sense orientation are known in the art. The methods generally involve transforming plants with a DNA construct comprising a promoter that drives expression in a plant operably linked to at least a portion of a nucleotide sequence that corresponds to the transcript of the endogenous gene. Typically, such a nucleotide sequence has substantial sequence identity to the sequence of the transcript of the endogenous gene, generally greater than about 65% sequence identity, about 85% sequence identity, or greater than about 95% sequence identity. See, U.S. Pat. Nos. 5,283,184 and 5,034,323; herein incorporated by reference.

The polynucleotide of interest can also be a phenotypic marker. A phenotypic marker is screenable or a selectable marker that includes visual markers and selectable markers whether it is a positive or negative selectable marker. Any phenotypic marker can be used. Specifically, a selectable or screenable marker comprises a DNA segment that allows one to identify, or select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions and the like.

Examples of selectable markers include, but are not limited to, DNA segments that comprise restriction enzyme sites; DNA segments that encode products which provide resistance against otherwise toxic compounds including antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Additional selectable markers include genes that confer resistance to herbicidal compounds, such as glufosinate ammonium, bromoxynil, imidazolinones, and 2,4-dichloro-phenoxyacetate (2,4-D). See for example, Yarranton, (1992) Curr Opin Biotech 3:506-11; Christopherson et al., (1992) Proc. Natl. Acad. Sci. USA 89:6314-8; Yao et al., (1992)

Cell 71:63-72; Reznikoff, (1992) Mol Microbiol 6:2419-22; Hu et al., (1987) Cell 48:555-66; Brown et al., (1987) Cell 49:603-12; Figge et al., (1988) Cell 52:713-22; Deuschle et al., (1989) Proc. Natl. Acad. Sci. USA 86:5400-4; Fuerst et al., (1989) Proc. Natl. Acad. Sci. USA 86:2549-53; Deuschle et al., (1990) Science 248:480-3; Gossen, (1993) Ph.D. Thesis, University of Heidelberg; Reines et al., (1993) Proc. Natl. Acad. Sci. USA 90:1917-21; Labow et al., (1990) Mol Cell Biol 10:3343-56; Zambretti et al., (1992) Proc. Natl. Acad. Sci. USA 89:3952-6; Baim et al., (1991) Proc. Natl. Acad. Sci. USA 88:5072-6; Wyborski et al., (1991) Nucleic Acids Res 19:4647-53; Hillen and Wissman, (1989) Topics Mol Struc Biol 10:143-62; Degenkolb et al., (1991) Antimicrob Agents Chemother 35:1591-5; Kleinschnidt et al., (1988) Biochemistry 27:1094-104; Bonin, (1993) Ph.D. Thesis, University of Heidelberg; Gossen et al., (1992) Proc. Natl. Acad. Sci. USA 89:5547-51; Oliva et al., (1992) Antimicrob Agents Chemother 36:913-9; Hlavka et al., (1985) Handbook of Experimental Pharmacology, Vol. 78 (Springer-Verlag, Berlin); Gill et al., (1988) Nature 334:721-4. Commercial traits can also be encoded on a gene or genes that could increase for example, starch for ethanol production, or provide expression of proteins. Another important commercial use of transformed plants is the production of polymers and bioplastics such as described in U.S. Pat. No. 5,602,321. Genes such as β-Ketothiolase, PHBase (polyhydroxyburyrate synthase), and acetoacetyl-CoA reductase (see Schubert et al. (1988) *J. Bacteriol.* 170:5837-5847) facilitate expression of polyhyroxyalkanoates (PHAs).

Exogenous products include plant enzymes and products as well as those from other sources including prokaryotes and other eukaryotes. Such products include enzymes, cofactors, hormones, and the like. The level of proteins, particularly modified proteins having improved amino acid distribution to improve the nutrient value of the plant, can be increased. This is achieved by the expression of such proteins having enhanced amino acid content.

The transgenes, recombinant DNA molecules, DNA sequences of interest, and polynucleotides of interest can be comprise one or more DNA sequences for gene silencing. Methods for gene silencing involving the expression of DNA sequences in plant are known in the art include, but are not limited to, cosuppression, antisense suppression, double-stranded RNA (dsRNA) interference, hairpin RNA (hpRNA) interference, intron-containing hairpin RNA (ihpRNA) interference, transcriptional gene silencing, and micro RNA (miRNA) interference As used herein, "nucleic acid" means a polynucleotide and includes a single or a double-stranded polymer of deoxyribonucleotide or ribonucleotide bases. Nucleic acids may also include fragments and modified nucleotides. Thus, the terms "polynucleotide", "nucleic acid sequence", "nucleotide sequence" and "nucleic acid fragment" are used interchangeably to denote a polymer of RNA and/or DNA that is single- or double-stranded, optionally containing synthetic, non-natural, or altered nucleotide bases. Nucleotides (usually found in their 5'-monophosphate form) are referred to by their single letter designation as follows: "A" for adenosine or deoxyadenosine (for RNA or DNA, respectively), "C" for cytosine or deoxycytosine, "G" for guanosine or deoxyguanosine, "U" for uridine, "T" for deoxythymidine, "R" for purines (A or G), "Y" for pyrimidines (C or T), "K" for G or T, "H" for A or C or T, "I" for inosine, and "N" for any nucleotide.

"Open reading frame" is abbreviated ORF.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of genes to produce the desired phenotype in a transformed plant. genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential to the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

Polynucleotide and polypeptide sequences, variants thereof, and the structural relationships of these sequences can be described by the terms "homology", "homologous", "substantially identical", "substantially similar" and "corresponding substantially" which are used interchangeably herein. These refer to polypeptide or nucleic acid fragments wherein changes in one or more amino acids or nucleotide bases do not affect the function of the molecule, such as the ability to mediate gene expression or to produce a certain phenotype. These terms also refer to modification(s) of nucleic acid fragments that do not substantially alter the functional properties of the resulting nucleic acid fragment relative to the initial, unmodified fragment. These modifications include deletion, substitution, and/or insertion of one or more nucleotides in the nucleic acid fragment.

Substantially similar nucleic acid sequences encompassed may be defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence in an in vitro hybridization assay. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salt(s)) at pH 7.0 to 8.3, and at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

"Sequence identity" or "identity" in the context of nucleic acid or polypeptide sequences includes the nucleic acid bases or amino acid residues in two sequences that are the same when aligned for maximum correspondence over a specified comparison window.

The term "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90% or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, WI). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, (1989) *CABIOS* 5:151-153; Higgins et al., (1992) *Comput Appl Biosci* 8:189-191) and found in the MegA-lign™ program of the LASERGENE bioinformatics computing suite (DNASTAR Inc., Madison, WI). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

The "Clustal W method of alignment" corresponds to the alignment method labeled Clustal W (described by Higgins and Sharp, (1989) *CABIOS* 5:151-153; Higgins et al., (1992) *Comput Appl Biosci* 8:189-191) and found in the MegA-lign™ v6.1 program of the LASERGENE bioinformatics computing suite (DNASTAR Inc., Madison, WI). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

Unless otherwise stated, sequence identity/similarity values provided herein refer to the value obtained using GAP Version 10 (GCG, Accelrys, San Diego, CA) using the following parameters: % identity and % similarity for a nucleotide sequence using a gap creation penalty weight of 50 and a gap length extension penalty weight of 3, and the nwsgapdna.cmp scoring matrix; % identity and % similarity for an amino acid sequence using a GAP creation penalty weight of 8 and a gap length extension penalty of 2, and the BLOSUM62 scoring matrix (Henikoff and Henikoff, (1989) *Proc. Natl. Acad. Sci. USA* 89:10915). GAP uses the algorithm of Needleman and Wunsch, (1970) *J Mol Biol* 48:443-53, to find an alignment of two complete sequences that maximizes the number of matches and minimizes the number of gaps. GAP considers all possible alignments and gap positions and creates the alignment with the largest number of matched bases and the fewest gaps, using a gap creation penalty and a gap extension penalty in units of matched bases.

"BLAST" is a searching algorithm provided by the National Center for Biotechnology Information (NCBI) used to find regions of similarity between biological sequences. The program compares nucleotide or protein sequences to sequence databases and calculates the statistical significance of matches to identify sequences having sufficient similarity to a query sequence such that the similarity would not be predicted to have occurred randomly. BLAST reports the identified sequences and their local alignment to the query sequence.

It is well understood by one skilled in the art that many levels of sequence identity are useful in identifying polypeptides from other species or modified naturally or synthetically wherein such polypeptides have the same or similar function or activity. Useful examples of percent identities include, but are not limited to, 50%, 55%, 60%, 65%, 70%, 75%, 80%, 85%, 90% or 95%, or any integer percentage from 50% to 100%. Indeed, any integer amino acid identity from 50% to 100% may be useful in describing the present disclosure, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

"Gene" includes a nucleic acid fragment that expresses a functional molecule such as, but not limited to, a specific protein, including regulatory sequences preceding (5' non-coding sequences) and following (3' non-coding sequences) the coding sequence. "Native gene" refers to a gene as found in nature with its own regulatory sequences.

A "mutated gene" is a gene that has been altered through human intervention. Such a "mutated gene" has a sequence that differs from the sequence of the corresponding non-mutated gene by at least one nucleotide addition, deletion, or substitution. In certain embodiments of the disclosure, the mutated gene comprises an alteration that results from a guide polynucleotide/Cas endonuclease system as disclosed herein. A mutated plant is a plant comprising a mutated gene.

Targeted mutation includes a mutation in a native gene that was made by altering a target sequence within the native gene using a method involving a double-strand-break-inducing agent that is capable of inducing a double-strand break in the DNA of the target sequence as disclosed herein or known in the art.

In one embodiment, the targeted mutation is the result of a guideRNA/Cas endonuclease induced gene editing, without incorporating a selectable transgene marker, as described herein. The guide RNA/Cas endonuclease induced targeted mutation can occur in a nucleotide sequence that is located within or outside a genomic target site that is recognized and cleaved by a Cas endonuclease.

The term "genome" as it applies to a plant cells encompasses not only chromosomal DNA found within the nucleus, but organelle DNA found within subcellular components (e.g., mitochondria, or plastid) of the cell.

A "codon-modified gene" or "codon-preferred gene" or "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same, that plant is homozygous at that locus. If the alleles present at a given locus on a chromosome differ, that plant is heterozygous at that locus.

"Coding sequence" refers to a polynucleotide sequence which codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, 5' untranslated sequences, 3' untranslated sequences, introns, polyadenylation target sequences, RNA processing sites, effector binding sites, and stem-loop structures.

"A plant-optimized nucleotide sequence" is nucleotide sequence that has been optimized for increased expression in plants, particularly for increased expression in plants or in one or more plants of interest. For example, a plant-optimized nucleotide sequence can be synthesized by modifying a nucleotide sequence encoding a protein such as, for example, double-strand-break-inducing agent (e.g., an endonuclease) as disclosed herein, using one or more plant-preferred codons for improved expression. See, for example, Campbell and Gowri (1990) *Plant Physiol.* 92:1-11 for a discussion of host-preferred codon usage.

Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference. Additional sequence modifications are known to enhance gene expression in a plant host. These include, for example, elimination of: one or more sequences encoding spurious polyadenylation signals, one or more exon-intron splice site signals, one or more transposon-like repeats, and other such well-characterized sequences that may be deleterious to gene expression. The G-C content of the sequence may be adjusted to levels average for a given plant host, as calculated by reference to known genes expressed in the host plant cell. When possible, the sequence is modified to avoid one or more predicted hairpin secondary mRNA structures. Thus, "a plant-optimized nucleotide sequence" of the present disclosure comprises one or more of such sequence modifications.

"Promoter" refers to a DNA sequence capable of controlling the expression of a coding sequence or functional RNA. The promoter sequence consists of proximal and more distal upstream elements, the latter elements often referred to as enhancers. An "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, and/or comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters".

It has been shown that certain promoters are able to direct RNA synthesis at a higher rate than others. These are called "strong promoters". Certain other promoters have been shown to direct RNA synthesis at higher levels only in particular types of cells or tissues and are often referred to as "tissue specific promoters", or "tissue-preferred promoters" if the promoters direct RNA synthesis preferably in certain tissues but also in other tissues at reduced levels. Since patterns of expression of a chimeric gene (or genes) introduced into a plant are controlled using promoters, there is an ongoing interest in the isolation of novel promoters which are capable of controlling the expression of a chimeric gene or (genes) at certain levels in specific tissue types or at specific plant developmental stages.

New promoters of various types useful in plant cells are constantly being discovered; numerous examples may be found in the compilation by Okamuro and Goldberg, (1989) In *The Biochemistry of Plants*, Vol. 115, Stumpf and Conn, eds (New York, NY: Academic Press), pp. 1-82.

"Translation leader sequence" refers to a polynucleotide sequence located between the promoter sequence of a gene and the coding sequence. The translation leader sequence is present in the mRNA upstream of the translation start sequence. The translation leader sequence may affect processing of the primary transcript to mRNA, mRNA stability or translation efficiency. Examples of translation leader sequences have been described (e.g., Turner and Foster, (1995) *Mol Biotechnol* 3:225-236).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., (1989) *Plant Cell* 1:671-680.

"RNA transcript" refers to the product resulting from RNA polymerase-catalyzed transcription of a DNA sequence. When the RNA transcript is a perfect complimentary copy of the DNA sequence, it is referred to as the primary transcript or pre-mRNA. A RNA transcript is referred to as the mature RNA or mRNA when it is a RNA sequence derived from post-transcriptional processing of the primary transcript pre mRNAt. "Messenger RNA" or "mRNA" refers to the RNA that is without introns and that can be translated into protein by the cell. "cDNA" refers to a DNA that is complementary to, and synthesized from, a mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (see, e.g., U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" includes antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook et al., *Molecular Cloning: A Laboratory Manual; Cold Spring Harbor Laboratory*: Cold Spring Harbor, NY (1989). Transformation methods are well known to those skilled in the art and are described infra.

"PCR" or "polymerase chain reaction" is a technique for the synthesis of specific DNA segments and consists of a series of repetitive denaturation, annealing, and extension cycles. Typically, a double-stranded DNA is heat denatured, and two primers complementary to the 3' boundaries of the target segment are annealed to the DNA at low temperature, and then extended at an intermediate temperature. One set of these three consecutive steps is referred to as a "cycle".

The term "recombinant" refers to an artificial combination of two otherwise separated segments of sequence, e.g., by chemical synthesis, or manipulation of isolated segments of nucleic acids by genetic engineering techniques.

The terms "plasmid", "vector" and "cassette" refer to an extra chromosomal element often carrying genes that are not part of the central metabolism of the cell, and usually in the form of double-stranded DNA. Such elements may be autonomously replicating sequences, genome integrating sequences, phage, or nucleotide sequences, in linear or circular form, of a single- or double-stranded DNA or RNA, derived from any source, in which a number of nucleotide sequences have been joined or recombined into a unique construction which is capable of introducing a polynucleotide of interest into a cell. "Transformation cassette" refers to a specific vector containing a gene and having elements in addition to the gene that facilitates transformation of a particular host cell. "Expression cassette" refers to a specific vector containing a gene and having elements in addition to the gene that allow for expression of that gene in a host.

The terms "recombinant DNA molecule", "recombinant construct", "expression construct", "construct", "construct", and "recombinant DNA construct" are used interchangeably herein. A recombinant construct comprises an artificial combination of nucleic acid fragments, e.g., regulatory and coding sequences that are not all found together in nature. For example, a construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells. The skilled artisan will also recognize that different independent transformation events may result in different levels and patterns of expression (Jones et al., (1985) *EMBO J* 4:2411-2418; De Almeida et al., (1989) *Mol Gen Genetics* 218:78-86), and thus that multiple events are typically screened in order to obtain lines displaying the desired expression level and pattern. Such screening may be accomplished standard molecular biological, biochemical, and other assays including Southern analysis of DNA, Northern analysis of mRNA expression, PCR, real time quantitative PCR (qPCR), reverse transcription PCR (RT-PCR), immunoblotting analysis of protein expression, enzyme or activity assays, and/or phenotypic analysis.

The term "expression", as used herein, refers to the production of a functional end-product (e.g., an mRNA, guide RNA, or a protein) in either precursor or mature form.

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid, or mitochondrial DNA), converted into an autonomous replicon, or transiently expressed (e.g., transfected mRNA).

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or other DNA-containing organelle, of a host organism resulting in gene expression without integration or stable inheritance. Host organisms containing the transformed nucleic acid fragments are referred to as "transgenic" organisms.

The commercial development of genetically improved germplasm has also advanced to the stage of introducing multiple traits into crop plants, often referred to as a gene stacking approach. In this approach, multiple genes conferring different characteristics of interest can be introduced into a plant. Gene stacking can be accomplished by many means including but not limited to co-transformation, retransformation, and crossing lines with different genes of interest.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores. Plant parts include differentiated and undifferentiated tissues including, but not limited to roots, stems, shoots, leaves, pollens, seeds, tumor tissue and various forms of cells and culture (e.g., single cells, protoplasts, embryos, and callus tissue). The plant tissue may be in plant or in a plant organ, tissue or cell culture. The term "plant organ" refers to plant tissue or a group of tissues that constitute a morphologically and functionally distinct part of a plant. The term "genome" refers to the entire complement of genetic material (genes and non-coding sequences) that is present in each cell of an organism, or virus or organelle; and/or a complete set of chromosomes inherited as a (haploid) unit from one parent. "Progeny" comprises any subsequent generation of a plant.

A transgenic plant includes, for example, a plant which comprises within its genome a heterologous polynucleotide introduced by a transformation step. The heterologous polynucleotide can be stably integrated within the genome such that the polynucleotide is passed on to successive generations. The heterologous polynucleotide may be integrated into the genome alone or as part of a recombinant DNA construct. A transgenic plant can also comprise more than one heterologous polynucleotide within its genome. Each heterologous polynucleotide may confer a different trait to the transgenic plant. A heterologous polynucleotide can include a sequence that originates from a foreign species, or, if from the same species, can be substantially modified from its native form. Transgenic can include any cell, cell line, callus, tissue, plant part or plant, the genotype of which has been altered by the presence of heterologous nucleic acid including those transgenics initially so altered as well as those created by sexual crosses or asexual propagation from the initial transgenic. The alterations of the genome (chromosomal or extra-chromosomal) by conventional plant breeding methods, by the genome editing procedure described herein that does not result in an insertion of a foreign polynucleotide, or by naturally occurring events such as random cross-fertilization, non-recombinant viral infection, non-recombinant bacterial transformation, non-recombinant transposition, or spontaneous mutation are not intended to be regarded as transgenic.

In certain embodiments of the disclosure, a fertile plant is a plant that produces viable male and female gametes and is self-fertile. Such a self-fertile plant can produce a progeny plant without the contribution from any other plant of a gamete and the genetic material contained therein. Other embodiments of the disclosure can involve the use of a plant that is not self-fertile because the plant does not produce male gametes, or female gametes, or both, that are viable or otherwise capable of fertilization. As used herein, a "male sterile plant" is a plant that does not produce male gametes that are viable or otherwise capable of fertilization. As used herein, a "female sterile plant" is a plant that does not produce female gametes that are viable or otherwise capable of fertilization. It is recognized that male-sterile and female-sterile plants can be female-fertile and male-fertile, respectively. It is further recognized that a male fertile (but female sterile) plant can produce viable progeny when crossed with a female fertile plant and that a female fertile (but male sterile) plant can produce viable progeny when crossed with a male fertile plant.

A "centimorgan" (cM) or "map unit" is the distance between two linked genes, markers, target sites, loci, or any pair thereof, wherein 1% of the products of meiosis are recombinant. Thus, a centimorgan is equivalent to a distance equal to an 1% average recombination frequency between the two linked genes, markers, target sites, loci, or any pair thereof.

Breeding Methods and Methods for Selecting Plants Utilizing a Two Component RNA Guide and Cas Endonuclease System The present disclosure finds use in the breeding of plants comprising one or more transgenic traits. Most commonly, transgenic traits are randomly inserted throughout the plant genome as a consequence of transformation systems based on *Agrobacterium*, biolistics, or other commonly used procedures. More recently, gene targeting protocols have been developed that enable directed transgene insertion. One important technology, site-specific integration (SSI) enables the targeting of a transgene to the same chromosomal location as a previously inserted transgene. Custom-designed meganucleases and custom-designed zinc finger meganucleases allow researchers to design nucleases to target specific chromosomal locations, and these reagents allow the targeting of transgenes at the chromosomal site cleaved by these nucleases.

The currently used systems for precision genetic engineering of eukaryotic genomes, e.g. plant genomes, rely upon homing endonucleases, meganucleases, zinc finger nucleases, and transcription activator-like effector nucleases (TALENs), which require de novo protein engineering for every new target locus. The highly specific, RNA-directed DNA nuclease, guide RNA/Cas9 endonuclease system described herein, is more easily customizable and therefore more useful when modification of many different target sequences is the goal. This disclosure takes further advantage of the two component nature of the guide RNA/Cas system, with its constant protein component, the Cas endonuclease, and its variable and easily reprogrammable targeting component, the guide RNA or the crRNA.

The guide RNA/Cas system described herein is especially useful for genome engineering, especially plant genome engineering, in circumstances where nuclease off-target cutting can be toxic to the targeted cells. In one embodiment of the guide RNA/Cas system described herein, the constant component, in the form of an expression-optimized Cas9 gene, is stably integrated into the target genome, e.g. plant genome. Expression of the Cas9 gene is under control of a promoter, e.g. plant promoter, which can be a constitutive promoter, tissue-specific promoter or inducible promoter, e.g. temperature-inducible, stress-inducible, developmental stage inducible, or chemically inducible promoter. In the absence of the variable component, i.e. the guide RNA or crRNA, the Cas9 protein is not able to cut DNA and therefore its presence in the plant cell should have little or no consequence. Hence a key advantage of the guide RNA/Cas system described herein is the ability to create and maintain a cell line or transgenic organism capable of efficient expression of the Cas9 protein with little or no consequence to cell viability. In order to induce cutting at desired genomic sites to achieve targeted genetic modifications, guide RNAs or crRNAs can be introduced by a variety of methods into cells containing the stably-integrated and expressed cas9 gene. For example, guide RNAs or crRNAs can be chemically or enzymatically synthesized, and introduced into the Cas9 expressing cells via direct delivery methods such a particle bombardment or electroporation.

Alternatively, genes capable of efficiently expressing guide RNAs or crRNAs in the target cells can be synthesized chemically, enzymatically or in a biological system, and these genes can be introduced into the Cas9 expressing cells via direct delivery methods such a particle bombardment, electroporation or biological delivery methods such as *Agrobacterium* mediated DNA delivery.

In one embodiment, the method comprises a method for introducing a polynucleotide of interest into a plant genome without introducing an exogenous selectable marker into said plant genome, the method comprising providing a first guide RNA, a first polynucleotide modification template, a second guide RNA, a second polynucleotide modification template, and a Cas endonuclease to a plant cell comprising a first endogenous gene that can be modified to confer herbicide resistance, wherein said first guide RNA and Cas endonuclease are capable of forming a first complex that enables the Cas endonuclease to introduce a double strand break at a first target site located in or near said first endogenous gene in the genome of said plant cell, wherein said first polynucleotide modification template comprises at least one nucleotide modification of said first endogenous gene to render said endogenous gene capable of conferring herbicide resistance to a plant cell, wherein said second guide RNA and Cas endonuclease are capable of forming a second complex that enables the Cas endonuclease to introduce a double strand break at a second target site in the genome of said plant cell, wherein said second polynucleotide modification template comprises at least one polynucleotide of interest to be introduced into said plant genome.

As disclosed herein, a guide RNA/Cas system mediating gene targeting without incorporating a selectable transgene marker can be used in methods for directing transgene insertion and/or for producing complex transgenic trait loci comprising multiple transgenes in a fashion similar as disclosed in WO2013/0198888 (published Aug. 1, 2013) where instead of using a double strand break inducing agent to introduce a gene of interest, a guide RNA/Cas system or a guide polynucleotide/Cas system as disclosed herein is used. In one embodiment, a complex transgenic trait locus is a genomic locus that has multiple transgenes genetically linked to each other. By inserting independent transgenes within 0.1, 0.2, 0.3, 04, 0.5, 1, 2, or even 5 centimorgans (cM) from each other, the transgenes can be bred as a single genetic locus (see, for example, U.S. patent application Ser. No. 13/427,138) or PCT application PCT/US2012/030061. After selecting a plant comprising a transgene, plants containing (at least) one transgenes can be crossed to form an F1 that contains both transgenes. In progeny from these F1 (F2 or BC1) 1/500 progeny would have the two different transgenes recombined onto the same chromosome. The complex locus can then be bred as single genetic locus with both transgene traits. This process can be repeated to stack as many traits as desired.

Chromosomal intervals that correlate with a phenotype or trait of interest can be identified. A variety of methods well known in the art are available for identifying chromosomal intervals. The boundaries of such chromosomal intervals are drawn to encompass markers that will be linked to the gene controlling the trait of interest. In other words, the chromosomal interval is drawn such that any marker that lies within that interval (including the terminal markers that define the boundaries of the interval) can be used as a marker for northern leaf blight resistance. In one embodiment, the chromosomal interval comprises at least one QTL, and furthermore, may indeed comprise more than one QTL. Close proximity of multiple QTLs in the same interval may obfuscate the correlation of a particular marker with a particular QTL, as one marker may demonstrate linkage to more than one QTL. Conversely, e.g., if two markers in close proximity show co-segregation with the desired phenotypic trait, it is sometimes unclear if each of those markers identify the same QTL or two different QTL. The term "quantitative trait locus" or "QTL" refers to a region of DNA that is associated with the differential expression of a quantitative phenotypic trait in at least one genetic background, e.g., in at least one breeding population. The region of the QTL encompasses or is closely linked to the gene or genes that affect the trait in question. An "allele of a QTL" can comprise multiple genes or other genetic factors within a contiguous genomic region or linkage group, such as a haplotype. An allele of a QTL can denote a haplotype within a specified window wherein said window is a contiguous genomic region that can be defined, and tracked, with a set of one or more polymorphic markers. A haplotype can be defined by the unique fingerprint of alleles at each marker within the specified window.

A variety of methods are available to identify those cells having an altered genome at or near a target site without using a screenable marker phenotype. Such methods can be viewed as directly analyzing a target sequence to detect any change in the target sequence, including but not limited to PCR methods, sequencing methods, nuclease digestion, Southern blots, and any combination thereof.

Proteins may be altered in various ways including amino acid substitutions, deletions, truncations, and insertions. Methods for such manipulations are generally known. For example, amino acid sequence variants of the protein(s) can be prepared by mutations in the DNA. Methods for mutagenesis and nucleotide sequence alterations include, for example, Kunkel, (1985) *Proc. Natl. Acad. Sci. USA* 82:488-92; Kunkel et al., (1987) *Meth Enzymol* 154:367-82; U.S. Pat. No. 4,873,192; Walker and Gaastra, eds. (1983) *Techniques in Molecular Biology* (MacMillan Publishing Company, New York) and the references cited therein. Guidance regarding amino acid substitutions not likely to affect biological activity of the protein is found, for example, in the model of Dayhoff et al., (1978) *Atlas of Protein Sequence and Structure* (Natl Biomed Res Found, Washington, D.C.). Conservative substitutions, such as exchanging one amino acid with another having similar properties, may be preferable. Conservative deletions, insertions, and amino acid substitutions are not expected to produce radical changes in the characteristics of the protein, and the effect of any substitution, deletion, insertion, or combination thereof can be evaluated by routine screening assays. Assays for double-strand-break-inducing activity are known and generally measure the overall activity and specificity of the agent on DNA substrates containing target sites.

A variety of methods are known for the introduction of nucleotide sequences and polypeptides into an organism, including, for example, transformation, sexual crossing, and the introduction of the polypeptide, DNA, or mRNA into the cell.

Methods for contacting, providing, and/or introducing a composition into various organisms are known and include but are not limited to, stable transformation methods, transient transformation methods, virus-mediated methods, and sexual breeding. Stable transformation indicates that the introduced polynucleotide integrates into the genome of the organism and is capable of being inherited by progeny thereof. Transient transformation indicates that the introduced composition is only temporarily expressed or present in the organism.

Protocols for introducing polynucleotides and polypeptides into plants may vary depending on the type of plant or plant cell targeted for transformation, such as monocot or dicot. Suitable methods of introducing polynucleotides and polypeptides into plant cells and subsequent insertion into the plant genome include microinjection (Crossway et al., (1986) *Biotechniques* 4:320-34 and U.S. Pat. No. 6,300,543), meristem transformation (U.S. Pat. No. 5,736,369), electroporation (Riggs et al., (1986) *Proc. Natl. Acad. Sci. USA* 83:5602-6, *Agrobacterium*-mediated transformation (U.S. Pat. Nos. 5,563,055 and 5,981,840), direct gene transfer (Paszkowski et al., (1984) *EMBO J* 3:2717-22), and ballistic particle acceleration (U.S. Pat. Nos. 4,945,050; 5,879,918; 5,886,244; 5,932,782; Tomes et al., (1995) "Direct DNA Transfer into Intact Plant Cells via Microprojectile Bombardment" in *Plant Cell, Tissue, and Organ Culture: Fundamental Methods*, ed. Gamborg & Phillips (Springer-Verlag, Berlin); McCabe et al., (1988) *Biotechnology* 6:923-6; Weissinger et al., (1988) *Ann Rev Genet* 22:421-77; Sanford et al., (1987) *Particulate Science and Technology* 5:27-37 (onion); Christou et al., (1988) *Plant Physiol* 87:671-4 (soybean); Finer and McMullen, (1991) *In Vitro Cell Dev Biol* 27P:175-82 (soybean); Singh et al., (1998) *Theor Appl Genet* 96:319-24 (soybean); Datta et al., (1990) *Biotechnology* 8:736-40 (rice); Klein et al., (1988) *Proc. Natl. Acad. Sci. USA* 85:4305-9 (maize); Klein et al., (1988) *Biotechnology* 6:559-63 (maize); U.S. Pat. Nos. 5,240,855; 5,322,783 and 5,324,646; Klein et al., (1988) *Plant Physiol* 91:440-4 (maize); Fromm et al., (1990) *Biotechnology* 8:833-9 (maize); Hooykaas-Van Slogteren et al., (1984) *Nature* 311:763-4; U.S. Pat. No. 5,736,369 (cereals); Bytebier et al., (1987) *Proc. Natl. Acad. Sci. USA* 84:5345-9 (Liliaceae); De Wet et al., (1985) in *The Experimental Manipulation of Ovule Tissues*, ed. Chapman et al., (*Longman*, New York), pp. 197-209 (pollen); Kaeppler et al., (1990) *Plant Cell Rep* 9:415-8) and Kaeppler et al., (1992) *Theor Appl Genet* 84:560-6 (whisker-mediated transformation); D'Halluin et al., (1992) *Plant Cell* 4:1495-505 (electroporation); Li et al., (1993) *Plant Cell Rep* 12:250-5; Christou and Ford (1995) *Annals Botany* 75:407-13 (rice) and Osjoda et al., (1996) *Nat Biotechnol* 14:745-50 (maize via *Agrobacterium tumefaciens*).

Alternatively, polynucleotides may be introduced into plants by contacting plants with a virus or viral nucleic acids. Generally, such methods involve incorporating a polynucleotide within a viral DNA or RNA molecule. In some examples a polypeptide of interest may be initially synthesized as part of a viral polyprotein, which is later processed by proteolysis in vivo or in vitro to produce the desired recombinant protein. Methods for introducing polynucleotides into plants and expressing a protein encoded therein, involving viral DNA or RNA molecules, are known, see, for example, U.S. Pat. Nos. 5,889,191, 5,889,190, 5,866,785, 5,589,367 and 5,316,931. Transient transformation methods include, but are not limited to, the introduction of polypeptides, such as a double-strand break inducing agent, directly into the organism, the introduction of polynucleotides such as DNA and/or RNA polynucleotides, and the introduction of the RNA transcript, such as an mRNA encoding a double-strand break inducing agent, into the organism. Such methods include, for example, microinjection or particle bombardment. See, for example Crossway et al., (1986) *Mol Gen Genet* 202:179-85; Nomura et al., (1986) *Plant Sci* 44:53-8; Hepler et al., (1994) *Proc. Natl. Acad. Sci. USA* 91:2176-80; and, Hush et al., (1994) *J Cell Sci* 107:775-84.

The term "dicot" refers to the subclass of angiosperm plants also knows as "dicotyledoneae" and includes reference to whole plants, plant organs (e.g., leaves, stems, roots, etc.), seeds, plant cells, and progeny of the same. Plant cell, as used herein includes, without limitation, seeds, suspension cultures, embryos, meristematic regions, callus tissue, leaves, roots, shoots, gametophytes, sporophytes, pollen, and microspores.

The term "crossed" or "cross" or "crossing" in the context of this disclosure means the fusion of gametes via pollination to produce progeny (i.e., cells, seeds, or plants). The term encompasses both sexual crosses (the pollination of one plant by another) and selfing (self-pollination, i.e., when the pollen and ovule (or microspores and megaspores) are from the same plant or genetically identical plants).

The term "introgression" refers to the transmission of a desired allele of a genetic locus from one genetic background to another. For example, introgression of a desired allele at a specified locus can be transmitted to at least one progeny plant via a sexual cross between two parent plants, where at least one of the parent plants has the desired allele within its genome. Alternatively, for example, transmission of an allele can occur by recombination between two donor genomes, e.g., in a fused protoplast, where at least one of the donor protoplasts has the desired allele in its genome. The desired allele can be, e.g., a transgene, a modified (mutated or edited) native allele, or a selected allele of a marker or QTL.

Standard DNA isolation, purification, molecular cloning, vector construction, and verification/characterization methods are well established, see, for example Sambrook et al., (1989) *Molecular Cloning: A Laboratory Manual*, (Cold Spring Harbor Laboratory Press, NY). Vectors and constructs include circular plasmids, and linear polynucleotides, comprising a polynucleotide of interest and optionally other components including linkers, adapters, regulatory regions, introns, restriction sites, enhancers, insulators, selectable markers, nucleotide sequences of interest, promoters, and/or other sites that aid in vector construction or analysis. In some examples a recognition site and/or target site can be contained within an intron, coding sequence, 5' UTRs, 3' UTRs, and/or regulatory regions.

The present disclosure further provides expression constructs for expressing in a plant, plant cell, or plant part a guide RNA/Cas system that is capable of binding to and creating a double strand break in a target site. In one embodiment, the expression constructs of the disclosure comprise a promoter operably linked to a nucleotide sequence encoding a Cas gene and a promoter operably linked to a guide RNA of the present disclosure. The promoter is capable of driving expression of an operably linked nucleotide sequence in a plant cell.

A promoter is a region of DNA involved in recognition and binding of RNA polymerase and other proteins to initiate transcription. A plant promoter is a promoter capable of initiating transcription in a plant cell, for a review of plant promoters, see, Potenza et al., (2004) *In Vitro Cell Dev Biol* 40:1-22. Constitutive promoters include, for example, the core promoter of the Rsyn7 promoter and other constitutive promoters disclosed in WO99/43838 and U.S. Pat. No. 6,072,050; the core CaMV 35S promoter (Odell et al., (1985) *Nature* 313:810-2); rice actin (McElroy et al., (1990) *Plant Cell* 2:163-71); ubiquitin (Christensen et al., (1989) *Plant Mol Biol* 12:619-32; Christensen et al., (1992) *Plant Mol Biol* 18:675-89); pEMU (Last et al., (1991) *Theor Appl Genet* 81:581-8); MAS (Velten et al., (1984) *EMBO J* 3:2723-30); ALS promoter (U.S. Pat. No. 5,659,026), and the like. Other constitutive promoters are described in, for example, U.S. Pat. Nos. 5,608,149; 5,608,144; 5,604,121; 5,569,597; 5,466,785; 5,399,680; 5,268,463; 5,608,142 and 6,177,611. In some examples an inducible promoter may be used. Pathogen-inducible promoters induced following infection by a pathogen include, but are not limited to those regulating expression of PR proteins, SAR proteins, beta-1, 3-glucanase, chitinase, etc.

Chemical-regulated promoters can be used to modulate the expression of a gene in a plant through the application of an exogenous chemical regulator. The promoter may be a chemical-inducible promoter, where application of the chemical induces gene expression, or a chemical-repressible promoter, where application of the chemical represses gene expression. Chemical-inducible promoters include, but are not limited to, the maize In2-2 promoter, activated by benzene sulfonamide herbicide safeners (De Veylder et al., (1997) *Plant Cell Physiol* 38:568-77), the maize GST promoter (GST-II-27, WO93/01294), activated by hydrophobic electrophilic compounds used as pre-emergent herbicides, and the tobacco PR-1a promoter (Ono et al., (2004) *Biosci Biotechnol Biochem* 68:803-7) activated by salicylic acid. Other chemical-regulated promoters include steroid-responsive promoters (see, for example, the glucocorticoid-inducible promoter (Schena et al., (1991) *Proc. Natl. Acad. Sci. USA* 88:10421-5; McNellis et al., (1998) *Plant J* 14:247-257); tetracycline-inducible and tetracycline-repressible promoters (Gatz et al., (1991) *Mol Gen Genet* 227:229-37; U.S. Pat. Nos. 5,814,618 and 5,789,156).

Tissue-preferred promoters can be utilized to target enhanced expression within a particular plant tissue. Tissue-preferred promoters include, for example, Kawamata et al., (1997) *Plant Cell Physiol* 38:792-803; Hansen et al., (1997) *Mol Gen Genet* 254:337-43; Russell et al., (1997) *Transgenic Res* 6:157-68; Rinehart et al., (1996) *Plant Physiol* 112:1331-41; Van Camp et al., (1996) *Plant Physiol* 112:525-35; Canevascini et al., (1996) *Plant Physiol* 112:513-524; Lam, (1994) *Results Probl Cell Differ* 20:181-96; and Guevara-Garcia et al., (1993) *Plant J* 4:495-505. Leaf-preferred promoters include, for example, Yamamoto et al., (1997) *Plant J* 12:255-65; Kwon et al., (1994) *Plant Physiol* 105:357-67; Yamamoto et al., (1994) *Plant Cell Physiol* 35:773-8; Gotor et al., (1993) *Plant J* 3:509-18; Orozco et al., (1993) *Plant Mol Biol* 23:1129-38; Matsuoka et al., (1993) *Proc. Natl. Acad. Sci. USA* 90:9586-90; Simpson et al., (1958) *EMBO J* 4:2723-9; Timko et al., (1988) *Nature* 318:57-8. Root-preferred promoters include, for example, Hire et al., (1992) *Plant Mol Biol* 20:207-18 (soybean root-specific glutamine synthase gene); Miao et al., (1991) *Plant Cell* 3:11-22 (cytosolic glutamine synthase (GS)); Keller and Baumgartner, (1991) *Plant Cell* 3:1051-61 (root-specific control element in the GRP 1.8 gene of French bean); Sanger et al., (1990) *Plant Mol Biol* 14:433-43 (root-specific promoter of *A. tumefaciens* mannopine synthase (MAS)); Bogusz et al., (1990) *Plant Cell* 2:633-41 (root-specific promoters isolated from *Parasponia andersonii* and *Trema tomentosa*); Leach and Aoyagi, (1991) *Plant Sci* 79:69-76 (*A. rhizogenes* rolC and rolD root-inducing genes); Teeri et al., (1989) *EMBO J* 8:343-50 (*Agrobacterium* wound-induced TR1' and TR2' genes); VfENOD-GRP3 gene promoter (Kuster et al., (1995) *Plant Mol Biol* 29:759-72); and rolB promoter (Capana et al., (1994) *Plant Mol Biol* 25:681-91; phaseolin gene (Murai et al., (1983) *Science* 23:476-82; Sengopta-Gopalen et al., (1988) *Proc. Natl. Acad. Sci. USA* 82:3320-4). See also, U.S. Pat. Nos. 5,837,876; 5,750,386; 5,633,363; 5,459,252; 5,401,836; 5,110,732 and 5,023,179.

Seed-preferred promoters include both seed-specific promoters active during seed development, as well as seed-germinating promoters active during seed germination. See, Thompson et al., (1989) *BioEssays* 10:108. Seed-preferred promoters include, but are not limited to, Cim1 (cytokinin-induced message); cZ19B1 (maize 19 kDa zein); and milps (myo-inositol-1-phosphate synthase); (WO00/11177; and U.S. Pat. No. 6,225,529). For dicots, seed-preferred promoters include, but are not limited to, bean β-phaseolin, napin, β-conglycinin, soybean lectin, cruciferin, and the like. For monocots, seed-preferred promoters include, but are not limited to, maize 15 kDa zein, 22 kDa zein, 27 kDa gamma zein, waxy, shrunken 1, shrunken 2, globulin 1, oleosin, and nuc1. See also, WO00/12733, where seed-preferred promoters from END1 and END2 genes are disclosed.

A phenotypic marker is a screenable or selectable marker that includes visual markers and selectable markers whether it is a positive or negative selectable marker. Any phenotypic marker can be used. Specifically, a selectable or screenable marker comprises a DNA segment that allows one to identify, or select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions and the like.

Examples of selectable markers include, but are not limited to, DNA segments that comprise restriction enzyme sites; DNA segments that encode products which provide resistance against otherwise toxic compounds including antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Additional selectable markers include genes that confer resistance to herbicidal compounds, such as glufosinate ammonium, bromoxynil, imidazolinones, and 2,4-dichlorophenoxyacetate (2,4-D). See for example, Yarranton, (1992) *Curr Opin Biotech* 3:506-11; Christopherson et al., (1992) *Proc. Natl. Acad. Sci. USA* 89:6314-8; Yao et al., (1992) *Cell* 71:63-72; Reznikoff, (1992) *Mol Microbiol* 6:2419-22; Hu et al., (1987) *Cell* 48:555-66; Brown et al., (1987) *Cell* 49:603-12; Figge et al., (1988) *Cell* 52:713-22; Deuschle et al., (1989) *Proc. Natl. Acad. Sci. USA* 86:5400-4; Fuerst et al., (1989) *Proc. Natl. Acad. Sci. USA* 86:2549-53; Deuschle et al., (1990) *Science* 248:480-3; Gossen, (1993) Ph.D. Thesis, University of Heidelberg; Reines et al., (1993) *Proc. Natl. Acad. Sci. USA* 90:1917-21; Labow et al., (1990) *Mol Cell Biol* 10:3343-56; Zambretti et al., (1992) *Proc. Natl. Acad. Sci.* USA 89:3952-6; Baim et al., (1991) *Proc. Natl. Acad. Sci. USA* 88:5072-6; Wyborski et al., (1991) *Nucleic Acids Res* 19:4647-53; Hillen and Wissman, (1989) *Topics Mol Struc Biol* 10:143-62; Degenkolb et al., (1991) *Antimicrob Agents Chemother* 35:1591-5; Kleinschnidt et al., (1988) *Biochemistry* 27:1094-104; Bonin, (1993) Ph.D. Thesis, University of Heidelberg; Gossen et al., (1992) *Proc. Natl. Acad. Sci.* USA 89:5547-51; Oliva et al., (1992) *Antimicrob Agents Chemother* 36:913-9; Hlavka et al., (1985) *Handbook of Experimental Pharmacology*, Vol. 78 (Springer-Verlag, Berlin); Gill et al., (1988) *Nature* 334:721-4.

The cells having the introduced sequence may be grown or regenerated into plants using conventional conditions, see for example, McCormick et al., (1986) *Plant Cell Rep* 5:81-4. These plants may then be grown, and either pollinated with the same transformed strain or with a different transformed or untransformed strain, and the resulting progeny having the desired characteristic and/or comprising the introduced polynucleotide or polypeptide identified. Two or more generations may be grown to ensure that the polynucleotide is stably maintained and inherited, and seeds harvested.

Any plant can be used, including monocot and dicot plants. Examples of monocot plants that can be used include, but are not limited to, corn (*Zea mays*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), wheat (*Triticum aestivum*), sugarcane (*Saccharum* spp.), oats (*Avena*), barley (*Hordeum*), switchgrass (*Panicum virgatum*), pineapple (*Ananas comosus*), banana (*Musa* spp.), palm, ornamentals, turfgrasses, and other grasses. Examples of dicot plants that can be used include, but are not limited to, soybean (*Glycine max*), canola (*Brassica napus* and *B. campestris*), alfalfa (*Medicago sativa*), tobacco (*Nicotiana tabacum*), Arabidopsis (*Arabidopsis thaliana*), sunflower (*Helianthus annuus*), cotton (*Gossypium arboreum*), and peanut (*Arachis hypogaea*), tomato (*Solanum lycopersicum*), potato (*Solanum tuberosum*) etc.

The transgenes, recombinant DNA molecules, DNA sequences of interest, and polynucleotides of interest can comprise one or more genes of interest. Such genes of interest can encode, for example, a protein that provides agronomic advantage to the plant.

Marker Assisted Selection and Breeding of Plants

A primary motivation for development of molecular markers in crop species is the potential for increased efficiency in plant breeding through marker assisted selection (MAS). Genetic marker alleles, or alternatively, quantitative trait loci (QTL alleles, are used to identify plants that contain a desired genotype at one or more loci, and that are expected to transfer the desired genotype, along with a desired phenotype to their progeny. Genetic marker alleles (or QTL alleles) can be used to identify plants that contain a desired genotype at one locus, or at several unlinked or linked loci (e.g., a haplotype), and that would be expected to transfer the desired genotype, along with a desired phenotype to their progeny. It will be appreciated that for the purposes of MAS, the term marker can encompass both marker and QTL loci.

After a desired phenotype and a polymorphic chromosomal locus, e.g., a marker locus or QTL, are determined to segregate together, it is possible to use those polymorphic loci to select for alleles corresponding to the desired phenotype—a process called marker-assisted selection (MAS). In brief, a nucleic acid corresponding to the marker nucleic acid is detected in a biological sample from a plant to be selected. This detection can take the form of hybridization of a probe nucleic acid to a marker, e.g., using allele-specific hybridization, southern blot analysis, northern blot analysis, in situ hybridization, hybridization of primers followed by PCR amplification of a region of the marker or the like. A variety of procedures for detecting markers are well known in the art. After the presence (or absence) of a particular marker in the biological sample is verified, the plant is selected, i.e., used to make progeny plants by selective breeding.

Plant breeders need to combine traits of interest with genes for high yield and other desirable traits to develop improved plant varieties. Screening for large numbers of samples can be expensive, time consuming, and unreliable. Use of markers, and/or genetically-linked nucleic acids is an effective method for selecting plant having the desired traits in breeding programs. For example, one advantage of marker-assisted selection over field evaluations is that MAS can be done at any time of year regardless of the growing season. Moreover, environmental effects are irrelevant to marker-assisted selection.

When a population is segregating for multiple loci affecting one or multiple traits, the efficiency of MAS compared to phenotypic screening becomes even greater because all the loci can be processed in the lab together from a single sample of DNA.

The DNA repair mechanisms of cells are the basis to introduce extraneous DNA or induce mutations on endogenous genes. DNA homologous recombination is a specialized way of DNA repair that the cells repair DNA damages using a homologous sequence. In plants, DNA homologous recombination happens at frequencies too low to be routinely used in gene targeting or gene editing until it has been found that the process can be stimulated by DNA double-strand breaks (Bibikova et al., (2001) Mol. Cell Biol. 21:289-297; Puchta and Baltimore, (2003) Science 300:763; Wright et al., (2005) Plant J. 44:693-705).

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "pmole" mean micromole(s), "g" means gram(s), "µg" means microgram(s), "ng" means nanogram(s), "U" means unit(s), "bp" means base pair(s) and "kb" means kilobase(s).

Also, as described herein, for each example or embodiment that cites a guide RNA, a similar guide polynucleotide can be designed wherein the guide polynucleotide does not solely comprise ribonucleic acids but wherein the guide polynucleotide comprises a combination of RNA-DNA molecules or solely comprises DNA molecules.

Non-limiting examples of compositions and methods disclosed herein are as follows:

1. A method for producing a genetic modification into a second gene of a plant genome without introducing an exogenous selectable marker into said plant genome, the method comprising providing a first guide polynucleotide, a polynucleotide modification template, a second guide polynucleotide, and a Cas endonuclease to a plant cell comprising a first endogenous gene that can be modified to confer herbicide resistance, wherein said first guide polynucleotide and Cas endonuclease are capable of forming a first complex that enables the Cas endonuclease to introduce a double strand break at a first target site, located in or near said first endogenous gene in the genome of said plant cell, wherein said second guide polynucleotide and Cas endonuclease are capable of forming a second complex that enables the Cas endonuclease to introduce a double strand break at a second target site in the genome of said plant cell, wherein said polynucleotide modification template comprises at least one nucleotide alteration when compared to the first endogenous gene.
2. The method of embodiment 1, wherein said at least one nucleotide alteration encodes for an amino acid change in first endogenous gene.
3. The method of embodiment 1, wherein said first endogenous gene is modified to confer herbicide resistance to a plant cell.
4. The method of embodiment 1, wherein said first endogenous gene is selected from the group consisting of an acetolactate synthase (ALS) and an enolpyruvylshikimate-3-phosphate synthase (EPSPS) gene.
5. The method of embodiment 1, wherein the first target site and the second target site are located at two different genomic loci.
6. The method of embodiment 4, wherein the endogenous ALS gene is modified to confer sulfonylurea resistance.
7. The method of embodiment 4, wherein the endogenous EPSPS gene is modified to confer glyphosate resistance.
8. The method of embodiment 1, wherein Cas endonuclease is a Cas9 endonuclease
9. The method of embodiment 1, further comprising selecting at least one plant cell that has resistance to an herbicide and comprises a modification into said second gene, wherein said modification includes at least one deletion, insertion or substitution of one or more nucleotides in said second gene of the plant genome.
10. The method of embodiment 9, wherein said herbicide is a sulphonylurea, such as chlorsulfuron or an imidazolinone herbicide.
11. The method of embodiment 9, wherein said modification into said second gene includes at least one deletion, insertion, or substitution of one or more nucleotides in a FAD2-1 gene.
12. A plant grown or cultured from the plant cell of embodiment 9, a seed thereof, or progeny thereof
13. The plant of embodiment 12, wherein the plant is a monocot or a dicot.
14. The plant of embodiment 13, wherein the monocot is selected from the group consisting of maize, rice, sorghum, rye, barley, wheat, millet, oats, sugarcane, turfgrass, or switchgrass.
15. The plant of embodiment 13, wherein the dicot is selected from the group consisting of soybean, canola, alfalfa, sunflower, cotton, tobacco, peanut, potato, tobacco, *Arabidopsis*, or safflower.
16. An herbicide resistant plant grown or cultured from the plant cell of embodiment 9, a seed thereof, or progeny thereof having herbicide resistance and a high oleic phenotype.
17. A method for introducing a polynucleotide of interest into a plant genome without introducing an exogenous selectable marker into said plant genome, the method comprising providing a first guide RNA, a first polynucleotide modification template, a second guide RNA, a second polynucleotide modification template, and a Cas endonuclease to a plant cell comprising a first endogenous gene that can be modified to confer herbicide resistance, wherein said first guide RNA and Cas endonuclease are capable of forming a first complex that enables the Cas endonuclease to introduce a double strand break at a first target site located in or near said first endogenous gene in the genome of said plant cell, wherein said first polynucleotide modification template comprises at least one nucleotide modification of said first endogenous gene to render said endogenous gene capable of conferring herbicide resistance to a plant cell, wherein said second guide RNA and Cas endonuclease are capable of forming a second complex that enables the Cas endonuclease to introduce a double strand break at a second target site in the genome of said plant cell, wherein said second polynucleotide modification template comprises at least one polynucleotide of interest to be introduced into said plant genome.
18. The method of embodiment 17, wherein the first target site and the second target site are located at two different genomic loci.
19. The method of embodiment 17, wherein said first endogenous gene is selected from the group consisting of a plant acetolactate synthase (ALS) and a plant enolpyruvylshikimate-3-phosphate synthase (EPSPS) gene.
20. The method of embodiment 17, wherein the endogenous ALS gene is modified to confer sulfonylurea resistance.
21. The method of embodiment 17, wherein the endogenous EPSPS gene is modified to confer glyphosate resistance.
22. The method of embodiment 17, wherein Cas endonuclease is a Cas9 endonuclease
23. The method of embodiment 17, further comprising selecting at least one plant cell that has resistance to an herbicide and comprises said at least one polynucleotide of interest in said plant genome.
24. The method of embodiment 17, wherein the at least one polynucleotide of interest is selected from the group consisting of herbicide-tolerance coding sequences, insecticidal coding sequences, nematicidal coding sequences, antimicrobial coding sequences, antifungal coding sequences, antiviral coding sequences, abiotic and biotic stress tolerance coding sequences, or sequences modifying plant traits such as yield, grain quality, nutrient content, starch quality and quantity, nitrogen fixation and/or utilization, and oil content and/or composition.
25. The method of embodiment 23, wherein said herbicide is a sulphonylurea, such as chlorsulfuron or an imidazolinone herbicide.
26. A plant grown or cultured from the plant cell of embodiment 23, a seed thereof, or progeny thereof
27. The plant of embodiment 26, wherein the plant is a monocot or a dicot.
28. An herbicide resistant plant grown or cultured from the plant cell of embodiment 23, a seed thereof, or progeny thereof having herbicide resistance and stably inherited the at least one polynucleotide of interest in said plant genome.
29. A method for editing a second gene of a plant genome without introducing an exogenous selectable marker into said plant genome, the method comprising providing a first guide RNA, a first polynucleotide modification template, a second guide RNA, a second polynucleotide modification template, and a Cas endonuclease to a plant cell comprising a first endogenous gene that can be modified to confer herbicide resistance, wherein said first guide RNA and Cas endonuclease are capable of forming a complex that enables the Cas endonuclease to introduce a double strand break at a first target site (located in or near said first endogenous gene) in the genome of said plant cell, wherein said first polynucleotide modification template comprises at least one nucleotide modification of said first endogenous gene to render said endogenous gene capable of conferring herbicide resistance to a plant cell, wherein said second guide RNA and Cas endonuclease are capable of forming a complex that enables the Cas endonuclease to introduce a double strand break at a second target site (located at a different locus than said first endogenous gene) in the genome of said plant cell, wherein said second polynucleotide modification template comprises at least one nucleotide alteration when compared to the second gene to be edited.
30. The method of embodiment 29, wherein said first endogenous gene is an acetolactate synthase (ALS) gene.
31. The method of embodiment 29, wherein the endogenous ALS gene is modified to confer sulfonylurea resistance.
32. The method of embodiment 29, wherein the second gene is an EPSPS gene modified to confer glyphosate resistance.
33. The method of embodiment 29, wherein Cas endonuclease is a Cas9 endonuclease
34. The method of embodiment 29, further comprising selecting at least one plant cell that has resistance to an herbicide and comprises a modified EPSPS gene that confers glyphosate resistance.
35. The method of embodiment 34, wherein said herbicide is a sulphonylurea, such as chlorsulfuron or an imidazolinone herbicide.
36. A plant grown or cultured from the plant cell of embodiment 34, a seed thereof, or progeny thereof
37. The plant of embodiment 36, wherein the plant is a monocot or a dicot.
38. A method of generating a glyphosate resistant soybean plant without introducing an exogenous selectable marker into said plant genome the method comprising providing a maize plant cell wherein its endogenous chromosomal ALS gene and endogenous chromosomal EPSPS gene have been modified through a guide RNA/Cas endonuclease system to produce a glyphosate resistant EPSPS protein and growing a maize plant from said maize plant cell, wherein said plant is resistant to glyphosate.

EXAMPLES

In the following Examples, unless otherwise stated, parts and percentages are by weight and degrees are Celsius. It should be understood that these Examples, while indicating embodiments of the disclosure, are given by way of illustration only. From the above discussion and these Examples, one skilled in the art can make various changes and modifications of the disclosure to adapt it to various usages and conditions. Such modifications are also intended to fall within the scope of the appended claims.

Example 1

Maize Optimized Expression Cassettes for Guide RNA/Cas Endonuclease Based Genome Modification in Maize Plants For genome engineering applications, the type II CRISPR/Cas system minimally requires the Cas9 protein and a duplexed crRNA/tracrRNA molecule or a synthetically fused crRNA and tracrRNA (guide RNA) molecule for DNA target site recognition and cleavage (Gasiunas et al. (2012) *Proc. Natl. Acad. Sci. USA* 109:E2579-86, Jinek et al. (2012) *Science* 337:816-21, Mali et al. (2013) *Science* 339:823-26, and Cong et al. (2013) *Science* 339:819-23). Described herein is a guideRNA/Cas endonuclease system that is based on the type II CRISPR/Cas system and consists of a Cas endonuclease and a guide RNA (or duplexed crRNA and tracrRNA) that together can form a complex that recognizes a genomic target site in a plant and introduces a double-strand-break into said target site.

To test the guide RNA/Cas endonuclease system in maize, the Cas9 gene from *Streptococcus pyogenes* M1 GAS (SF370) (SEQ ID NO: 1) was maize codon optimized per standard techniques known in the art and the potato ST-LS1 intron (SEQ ID NO: 2) was introduced in order to eliminate its expression in *E. coli* and *Agrobacterium* (FIG. 1 A). To facilitate nuclear localization of the Cas9 protein in maize cells, *Simian virus* 40 (SV40) monopartite amino terminal nuclear localization signal (MAPKKKRKV, SEQ ID NO: 3) and *Agrobacterium tumefaciens* bipartite VirD2 T-DNA border endonuclease carboxyl terminal nuclear localization signal (KRPRDRHDGELGGRKRAR, SEQ ID NO: 4) were incorporated at the amino and carboxyl-termini of the Cas9 open reading frame (FIG. 1 A), respectively. The maize optimized Cas9 gene was operably linked to a maize constitutive or regulated promoter by standard molecular biological techniques. An example of the maize optimized Cas9 expression cassette (SEQ ID NO: 5) is illustrated in FIG. 1 A. FIG. 1A shows a maize optimized Cas9 gene containing the ST-LS1 intron, SV40 amino terminal nuclear localization signal (NLS) and VirD2 carboxyl terminal NLS driven by a plant Ubiquitin promoter.

The second component necessary to form a functional guide RNA/Cas endonuclease system for genome engineering applications is a duplex of the crRNA and tracrRNA molecules or a synthetic fusing of the crRNA and tracrRNA molecules, a guide RNA. To confer efficient guide RNA expression (or expression of the duplexed crRNA and tracrRNA) in maize, the maize U6 polymerase III promoter (SEQ ID NO: 9) and maize U6 polymerase III terminator (first 8 bases of SEQ ID NO: 10) residing on chromosome 8 were isolated and operably fused to the termini of a guide RNA (FIG. 1 B) using standard molecular biology techniques. Two different guide RNA configurations were developed for testing in maize, a short guide RNA (SEQ ID NO: 11) based on Jinek et al. (2012) Science 337:816-21 and a long guide RNA (SEQ ID NO: 8) based on Mali et al. (2013) Science 339:823-26. An example expression cassette (SEQ ID NO: 12) is shown in FIG. 1 B which illustrates a maize U6 polymerase III promoter driving expression of a long guide RNA terminated with a U6 polymerase III terminator.

As shown in FIGS. 2 A and 2B, the guide RNA or crRNA molecule contains a region complementary to one strand of the double strand DNA target (referred to as the variable targeting domain) that is approximately 12-30 nucleotides in length and upstream of a PAM sequence (5'NGG3' on antisense strand of FIG. 2A-2B, corresponding to 5'CCN3' on sense strand of FIG. 2A-2B) for target site recognition and cleavage (Gasiunas et al. (2012) Proc. Natl. Acad. Sci. USA 109:E2579-86, Jinek et al. (2012) Science 337:816-21, Mali et al. (2013) Science 339:823-26, and Cong et al. (2013) Science 339:819-23). To facilitate the rapid introduction of maize genomic DNA target sequences into the crRNA or guide RNA expression constructs, two Type IIS BbsI restriction endonuclease target sites were introduced in an inverted tandem orientation with cleavage orientated in an outward direction as described in Cong et al. (2013) Science 339:819-23. Upon cleavage, the Type IIS restriction endonuclease excises its target sites from the crRNA or guide RNA expression plasmid, generating overhangs allowing for the in-frame directional cloning of duplexed oligos containing the desired maize genomic DNA target site into the variable targeting domain. In this example, only target sequences starting with a G nucleotide were used to promote favorable polymerase III expression of the guide RNA or crRNA.

Expression of both the Cas endonuclease gene and the guide RNA then allows for the formation of the guide RNA/Cas complex depicted in FIG. 2 B (SEQ ID NO: 8). Alternatively, expression of the Cas endonucleases gene, crRNA, and tracrRNA allow for the formation of the crRNA/tracrRNA/Cas complex as depicted in FIG. 2 A, (SEQ ID NOs: 6-7).

Example 2

The Guide RNA/Cas Endonuclease System Cleaves Chromosomal DNA in Maize and Introduces Mutations by Imperfect Non-Homologous End-Joining To test whether the maize optimized guide RNA/Cas endonuclease described in example 1 could recognize, cleave, and mutate maize chromosomal DNA through imprecise non-homologous end-joining (NHEJ) repair pathways, three different genomic target sequences in 5 maize loci were targeted for cleavage (see Table 1) and examined by deep sequencing for the presence of NHEJ mutations.

TABLE 1

Maize genomic target sites targeted by a guideRNA/Cas endonuclease system.

| Locus | Location | Guide RNA Used | Target Site Designation | Maize Genomic Target Site Sequence | PAM Sequence | SEQ ID NO: |
|---|---|---|---|---|---|---|
| MS26 | Chr. 1: 51.81cM | Long | MS26Cas-1 | GTACTCCATCCGCCCCATCGAGTA | GGG | 13 |
|  |  | Long | MS26Cas-2 | GCACGTACGTCACCATCCCGC | CGG | 14 |
|  |  | Long | MS26Cas-3 | GACGTACGTGCCCTACTCGAT | GGG | 15 |
| LIG | Chr. 2: 28.45cM | Long | LIGCas-1 | GTACCGTACGTGCCCCGGCGG | AGG | 16 |
|  |  | Long | LIGCas-2 | GGAATTGTACCGTACGTGCCC | CGG | 17 |
|  |  | Long | LIGCas-3 | GCGTACGCGTACGTGTG | AGG | 18 |
| MS45 | Chr. 9: 119.15cM | Long | MS45Cas-1 | GCTGGCCGAGGTCGACTAC | CGG | 19 |
|  |  | Long | MS45Cas-2 | GGCCGAGGTCGACTACCGGC | CGG | 20 |
|  |  | Long | MS45Cas-3 | GGCGCGAGCTCGTGCTTCAC | CGG | 21 |
| ALS | Chr. 4: 107.73cM and Chr. 5: 115.49cM | Long | ALSCas-1 | GGTGCCAATCATGCGTCG | CGG | 22 |
|  |  | Long | ALSCas-2 | GGTCGCCATCACGGGAC | AGG | 23 |
|  |  | Long | ALSCas-3 | GTCGCGGCACCTGTCCCGTGA | TGG | 24 |
| EPSPS | Chr. 9: 69.43cM | Long | EPSPSCas-1 | GGAATGCTGGAACTGCAATG | CGG | 25 |
|  |  | Long | EPSPSCas-2 | GCAGCTCTTCTTGGGGAATGC | TGG | 26 |
|  |  | Long | EPSPSCas-3 | GCAGTAACAGCTGCTGTCAA | TGG | 27 |

MS26 = Male Sterility Gene 26, LIG = Liguleless 1 Gene Promoter, MS45 = Male Sterility Gene 45, ALS = Acetolactate Synthase Gene, EPSPS = Enolpyruvylshikimate Phosphate Synthase Gene The maize optimized Cas9 endonuclease and long guide RNA expression cassettes containing the specific maize variable targeting domains were co-delivered to 60-90 Hi-II immature maize embryos by particle-mediated delivery (see Example 10) in the presence of BBM and WUS2 genes (see Example 11). Hi-II maize embryos transformed with either the LIG3-4 or MS26++ homing endonucleases (see Example 9) targeting the same maize genomic loci as the LIGCas or MS26Cas target sites served as a positive control and embryos transformed with only the Cas9 or guide RNA expression cassette served as negative controls. After 7 days, the 20-30 most uniformly transformed embryos from each treatment were pooled and total genomic DNA was extracted. The region surrounding the intended target site was PCR amplified with Phusion® High Fidelity PCR Master Mix (New England Biolabs, M0531 L) adding on the sequences necessary for amplicon-specific barcodes and Illumnia sequencing using "tailed" primers through two rounds of PCR. The primers used in the primary PCR reaction are shown in Table 2 and the primers used in the secondary PCR reaction were AATGATACGGCGAC-CACCGAGATCTACACTCTTTCCCTACACG (forward, SEQ ID NO: 53) and CAAGCAGAAGACGGCATA (reverse, SEQ ID NO: 54).

TABLE 2

PCR primer sequences

| Target Site | Primer Orientation | Primary PCR Primer Sequence | SEQ ID NO: |
|---|---|---|---|
| MS26Cas-1 | Forward | CTACACTCTTTCCCTACACGACGCTCTTCCGATCTAGGACCGGAAGCTCGCCGCGT | 28 |
| MS26Cas-1 | Reverse | CAAGCAGAAGACGGCATACGAGCTCTTCCGATCTTCCTGGAGGACGACGTGCTG | 29 |
| MS26Cas-2 | Forward | CTACACTCTTTCCCTACACGACGCTCTTCCGATCTAAGGTCCTGGAGGACGACGTGCTG | 30 |
| MS26Cas-2 | Reverse | CAAGCAGAAGACGGCATACGAGCTCTTCCGATCTCCGGAAGCTCGCCGCGT | 31 |
| MS26Cas-3 | Forward | CTACACTCTTTCCCTACACGACGCTCTTCCGATCTTCCTCCGGAAGCTCGCCGCGT | 32 |
| MS26Cas-3 | Reverse | CAAGCAGAAGACGGCATACGAGCTCTTCCGATCTTCCTGGAGGACGACGTGCTG | 29 |
| MS26 Meganuclease | Forward | CTACACTCTTTCCCTACACGACGCTCTTCCGATCTTTCCTCCTGGAGGACGACGTGCTG | 33 |
| MS26 Meganuclease | Reverse | CAAGCAGAAGACGGCATACGAGCTCTTCCGATCTCCGGAAGCTCGCCGCGT | 31 |
| LIGCas-1 | Forward | CTACACTCTTTCCCTACACGACGCTCTTCCGATCTAGGACTGTAACGATTTACGCACCTGCTG | 34 |
| LIGCas-1 | Reverse | CAAGCAGAAGACGGCATACGAGCTCTTCCGATCTGCAAATGAGTAGCAGCGCACGTAT | 35 |
| LIGCas-2 | Forward | CTACACTCTTTCCCTACACGACGCTCTTCCGATCTTCCTCTGTAACGATTTACGCACCTGCTG | 36 |
| LIGCas-2 | Reverse | CAAGCAGAAGACGGCATACGAGCTCTTCCGATCTGCAAATGAGTAGCAGCGCACGTAT | 35 |
| LIGCas-3 | Forward | CTACACTCTTTCCCTACACGACGCTCTTCCGATCTAAGGCGCAAATGAGTAGCAGCGCAC | 37 |
| LIGCas-3 | Reverse | CAAGCAGAAGACGGCATACGAGCTCTTCCGATCTCACCTGCTGGGAATTGTACCGTA | 38 |
| LIG3-4 Meganuclease | Forward | CTACACTCTTTCCCTACACGACGCTCTTCCGATCTCCTTCGCAAATGAGTAGCAGCGCAC | 39 |
| LIG3-4 Meganuclease | Reverse | CAAGCAGAAGACGGCATACGAGCTCTTCCGATCTCACCTGCTGGGAATTGTACCGTA | 38 |
| MS45Cas-1 | Forward | CTACACTCTTTCCCTACACGACGCTCTTCCGATCTAGGAGGACCCGTTCGGCCTCAGT | 40 |
| MS45Cas-1 | Reverse | CAAGCAGAAGACGGCATACGAGCTCTTCCGATCTGCCGGCTGGCATTGTCTCTG | 41 |
| MS45Cas-2 | Forward | CTACACTCTTTCCCTACACGACGCTCTTCCGATCTTCCTGGACCCGTTCGGCCTCAGT | 42 |
| MS45Cas-2 | Reverse | CAAGCAGAAGACGGCATACGAGCTCTTCCGATCTGCCGGCTGGCATTGTCTCTG | 41 |
| MS45Cas-3 | Forward | CTACACTCTTTCCCTACACGACGCTCTTCCGATCTGAAGGGACCCGTTCGGCCTCAGT | 43 |
| MS45Cas-3 | Reverse | CAAGCAGAAGACGGCATACGAGCTCTTCCGATCTGCCGGCTGGCATTGTCTCTG | 41 |
| ALSCas-1 | Forward | CTACACTCTTTCCCTACACGACGCTCTTCCGATCTAAGGCGACGATGGGCGTCTCCTG | 44 |

TABLE 2-continued

PCR primer sequences

| Target Site | Primer Orientation | Primary PCR Primer Sequence | SEQ ID NO: |
|---|---|---|---|
| ALSCas-1 | Reverse | CAAGCAGAAGACGGCATACGAGCTCTTCCGATCTGCGTCTGCATCGCCACCTC | 45 |
| ALSCas-2 | Forward | CTACACTCTTTCCCTACACGACGCTCTTCCGATCTTTCCCGACGATGGGCGTCTCCTG | 46 |
| ALSCas-2 | Reverse | CAAGCAGAAGACGGCATACGAGCTCTTCCGATCTGCGTCTGCATCGCCACCTC | 45 |
| ALSCas-3 | Forward | CTACACTCTTTCCCTACACGACGCTCTTCCGATCTGGAACGACGATGGGCGTCTCCTG | 47 |
| ALSCas-3 | Reverse | CAAGCAGAAGACGGCATACGAGCTCTTCCGATCTGCGTCTGCATCGCCACCTC | 45 |
| EPSPSCas-1 | Forward | CTACACTCTTTCCCTACACGACGCTCTTCCGATCTGGAAGAGGAAACATACGTTGCATTTCCA | 48 |
| EPSPSCas-1 | Reverse | CAAGCAGAAGACGGCATACGAGCTCTTCCGATCTGGTGGAAAGTTCCCAGTTGAGGA | 49 |
| EPSPSCas-2 | Forward | CTACACTCTTTCCCTACACGACGCTCTTCCGATCTAAGCGGTGGAAAGTTCCCAGTTGAGGA | 50 |
| EPSPSCas-2 | Reverse | CAAGCAGAAGACGGCATACGAGCTCTTCCGATCTGAGGAAACATACGTTGCATTTCCA | 51 |
| EPSPSCas-3 | Forward | CTACACTCTTTCCCTACACGACGCTCTTCCGATCTCCTTGAGGAAACATACGTTGCATTTCCA | 52 |
| EPSPSCas-3 | Reverse | CAAGCAGAAGACGGCATACGAGCTCTTCCGATCTGGTGGAAAGTTCCCAGTTGAGGA | 49 |

The resulting PCR amplifications were purified with a Qiagen PCR purification spin column, concentration measured with a Hoechst dye-based fluorometric assay, combined in an equimolar ratio, and single read 100 nucleotide-length deep sequencing was performed on Illumina's MiSeq Personal Sequencer with a 30-40% (v/v) spike of PhiX control v3 (Illumina, FC-110-3001) to off-set sequence bias. Only those reads with a ≥1 nucleotide indel arising within the 10 nucleotide window centered over the expected site of cleavage and not found in a similar level in the negative control were classified as NHEJ mutations. NHEJ mutant reads with the same mutation were counted and collapsed into a single read and the top 10 most prevalent mutations were visually confirmed as arising within the expected site of cleavage. The total numbers of visually confirmed NHEJ mutations were then used to calculate the % mutant reads based on the total number of reads of an appropriate length containing a perfect match to the barcode and forward primer.

The frequency of NHEJ mutations recovered by deep sequencing for the guide RNA/Cas endonuclease system targeting the three LIGCas targets (SEQ ID NOS: 16, 17, 18) compared to the LIG3-4 homing endonuclease targeting the same locus is shown in Table 3. The ten most prevalent types of NHEJ mutations recovered based on the guide RNA/Cas endonuclease system compared to the LIG3-4 homing endonuclease are shown in FIG. 3 A (corresponding to SEQ ID NOs: 55-75) and FIG. 3 B (corresponding to SEQ ID NOs: 76-96). Approximately, 12-23 fold higher frequencies of NHEJ mutations were observed when using a guide RNA/Cas system to introduce a double strand break at a maize genomic target site (Cas target sites), relative to the LIG3-4 homing endonuclease control. As shown in Table 4, a similar difference between the guide RNA/Cas system and meganuclease double-strand break technologies was observed at the MS26 locus with approximately 14-25 fold higher frequencies of NHEJ mutations when a guide RNA/Cas endonuclease system was used. High frequencies of NHEJ mutations were also recovered at the MS45, ALS and EPSPS Cas targets (see Table 5) when using a guide RNA/Cas endonuclease system. This data indicates that the guide RNA/Cas9 endonuclease system described herein can be effectively used to introduce an alteration at genomic sites of interest such as those related to male fertility, wherein an alteration results in the creation of a male sterile gene locus and male sterile plants. Altering the EPSPS target can result in the production of plants that are tolerant and/or resistant against glyphosate based herbicides. Altering the acetolactate synthase (ALS) gene target site can result in the production of plants that are tolerant and/or resistant to imidazolinone and sulphonylurea herbicides.

TABLE 3

Percent (%) mutant reads at maize Liguleless 1 target locus produced by a guide RNA/Cas system versus a homing endonuclease system.

| System | Total Number of Reads | Number of Mutant Reads | % Mutant Reads |
|---|---|---|---|
| Cas9 Only Control | 640,063 | 1 | 0.00% |
| guide RNA Only Control | 646,774 | 1 | 0.00% |

TABLE 3-continued

Percent (%) mutant reads at maize Liguleless 1 target locus produced by a guide RNA/Cas system versus a homing endonuclease system.

| System | Total Number of Reads | Number of Mutant Reads | % Mutant Reads |
| --- | --- | --- | --- |
| LIG3-4 Homing Endonuclease | 616,536 | 1,211 | 0.20% |
| LIGCas-1 guide/Cas9 | 716,854 | 33,050 | 4.61% |
| LIGCas-2 guide/Cas9 | 711,047 | 16,675 | 2.35% |
| LIGCas-3 guide/Cas9 | 713,183 | 27,959 | 3.92% |

TABLE 4

Percent (%) mutant reads at maize Male Sterility 26 target locus produced by a guide RNA/Cas system versus a homing endonuclease.

| System | Total Number of Reads | Number of Mutant Reads | % Mutant Reads |
| --- | --- | --- | --- |
| Cas9 Only Control | 403,123 | 15 | 0.00% |
| MS26++ Homing Endonuclease | 512,784 | 642 | 0.13% |
| MS26Cas-1 guide/Cas9 | 575,671 | 10,073 | 1.75% |
| MS26Cas-2 guide/Cas9 | 543,856 | 16,930 | 3.11% |
| MS26Cas-3 guide/Cas9 | 538,141 | 13,879 | 2.58% |

TABLE 5

Percent (%) mutant reads at maize Male Sterility 45, Acetolactate Synthase and Enolpyruvylshikimate Phosphate Synthase target loci produced by the guide RNA/Cas system.

| System | Total Number of Reads | Number of Mutant Reads | % Mutant Reads |
| --- | --- | --- | --- |
| Cas9 Only Control (MS45) | 899,500 | 27 | 0.00% |
| MS45Cas-1 guide/Cas9 | 812,644 | 3,795 | 0.47% |
| MS45Cas-2 guide/Cas9 | 785,183 | 14,704 | 1.87% |
| MS45Cas-3 guide/Cas9 | 728,023 | 9,203 | 1.26% |
| Cas9 Only Control (ALS) | 534,764 | 19 | 0.00% |
| ALSCas-1 guide/Cas9 | 434,452 | 9,669 | 2.23% |
| ALSCas-2 guide/Cas9 | 472,351 | 6,352 | 1.345% |
| ALSCas-3 guide/Cas9 | 497,786 | 8,535 | 1.715% |
| Cas9 Only Control (EPSPS) | 1,347,086 | 6 | 0.00% |
| EPSPSCas-1 guide/Cas9 | 1,420,274 | 13,051 | 0.92% |
| EPSPSCas-2 guide/Cas9 | 1,225,082 | 26,340 | 2.15% |
| EPSPSCas-3 guide/Cas9 | 1,406,905 | 53,603 | 3.81% |

Taken together, our data indicate that the maize optimized guide RNA/Cas endonuclease system described herein using a long guide RNA expression cassette efficiently cleaves maize chromosomal DNA and generates imperfect NHEJ mutations at frequencies greater than the engineered LIG3-4 and MS26++ homing endonucleases.

Example 3

Long Guide RNA of the Maize Optimized Guide RNA/Cas Endonuclease System Cleaves Maize Chromosomal DNA More Efficiently than the Short Guide RNA To determine the most effective guide RNA (comprising a fusion of the crRNA and tracrRNA) for use in maize, the recovery of NHEJ mutations using a short guide RNA (SEQ ID NO: 11) based on Jinek et al. (2012) Science 337:816-21 and a long guide RNA (SEQ ID NO: 8) based on Mali et al. (2013) Science 339:823-26 was examined.

The variable targeting domains of the guide RNA targeting the maize genomic target sites at the LIG locus (LIGCas-1, LIGCas-2 and LIGCas-3, SEQ ID NOs: 16, 17 and 18, Table 1) were introduced into both the maize optimized long and short guide RNA expression cassettes as described in Example 1 and co-transformed along with the maize optimized Cas9 endonuclease expression cassette into immature maize embryos and deep sequenced for NHEJ mutations as described in Example 2. Embryos transformed with only the Cas9 endonuclease expression cassette served as a negative control.

As shown in Table 6 below, the frequency of NHEJ mutations recovered with the long guide RNA far exceeded those obtained with the short guide RNA. This data indicates that the long guide RNA paired with the maize optimized Cas9 endonuclease gene described herein more efficiently cleaves maize chromosomal DNA.

TABLE 6

Percent (%) mutant reads at the maize Liguleless 1 target locus produced by a guide RNA/Cas system with a long versus a short guide RNA.

| System | guide RNA Used | Total Number of Reads | Number of Mutant Reads | % Mutant Reads |
| --- | --- | --- | --- | --- |
| Cas9 Only | N/A | 640,063 | 1 | 0.00% |
| LIGCas-1 guide/Cas9 | Short | 676,870 | 43 | 0.01% |
| LIGCas-2 guide/Cas9 | Short | 747,945 | 91 | 0.01% |
| LIGCas-3 guide/Cas9 | Short | 655,157 | 10 | 0.00% |
| LIGCas-1 guide/Cas9 | Long | 716,854 | 33,050 | 4.61% |
| LIGCas-2 guide/cas9 | Long | 711,047 | 16,675 | 2.35% |
| LIGCas-3 guide/Cas9 | Long | 713,183 | 27,959 | 3.92% |

Example 4

The Guide RNA/Cas Endonuclease System May be Multiplexed to Simultaneously Target Multiple Chromosomal Loci in Maize for Mutagenesis by Imperfect Non-Homologous End-Joining To test if multiple chromosomal loci may be simultaneously mutagenized with the guide RNA/maize optimized Cas endonuclease system described herein, the long guide RNA expression cassettes targeting the MS26Cas-2 target site (SEQ ID NO: 14), the LIGCas-3 target site (SEQ ID NO: 18) and the MS45Cas-2 target site (SEQ ID NO: 20), were co-transformed into maize embryos either in duplex or in triplex along with the Cas9 endonuclease expression cassette and examined by deep sequencing for the presence of imprecise NHEJ mutations as described in Example 2.

Hi-II maize embryos co-transformed with the Cas9 expression cassette and the corresponding guide RNA expression cassette singly served as a positive control and embryos transformed with only the Cas9 expression cassette served as a negative control.

As shown in Table 7 below, mutations resulting from imprecise NHEJ were recovered at all relevant loci when multiple guide RNA expression cassettes were simultaneously introduced either in duplex or triplex with frequencies of mutant reads near those of the positive control. Thus, demonstrating that the maize optimized guide RNA/Cas endonuclease system described herein may be used to simultaneously introduce imprecise NHEJ mutations at multiple loci in maize.

TABLE 7

Percent (%) mutant reads at maize target loci produced by a multiplexed guide RNA/Cas system.

| Target Site Examined for NHEJ Mutations | guide RNAs Co-transformed Individually, in Duplex, or in Triplex with Cas9 | Total Number of Reads | Number of Mutant Reads | % Mutant Reads |
|---|---|---|---|---|
| LIGCas-3, MS26Cas-2, MS45Cas-2 | None (Cas9 Only control) | 527,691 | 9 | 0.00% |
| LIGCas-3 | LIGCas-3 | 645,107 | 12,631 | 1.96% |
|  | LIGCas-3 MS26Cas-2 | 579,992 | 10,348 | 1.78% |
|  | LIGCas-3 MS26Cas-2 MS45Cas-2 | 648,901 | 12,094 | 1.86% |
| MS26Cas-2 | MS26 Cas 2 | 699,154 | 17,247 | 2.47% |
|  | LIGCas-3 MS26Cas-2 | 717,158 | 10,256 | 1.43% |
|  | MS26Cas-2 MS45Cas-2 | 613,431 | 9,931 | 1.62% |
|  | LIGCas-3 MS26Cas-2 MS45Cas-2 | 471,890 | 7,311 | 1.55% |
| MS45Cas-2 | MS45Cas-2 | 503,423 | 10,034 | 1.99% |
|  | MS26Cas-2 MS45Cas-2 | 480,178 | 8,008 | 1.67% |
|  | LIGCas-3 MS26Cas-2 MS45Cas-2 | 416,711 | 7,190 | 1.73% |

Example 5

Guide RNA/Cas Endonuclease Mediated DNA Cleavage in Maize Chromosomal Loci can Stimulate Homologous Recombination Repair-Mediated Transgene Insertion To test the utility of the maize optimized guide RNA/Cas system described herein to cleave maize chromosomal loci and stimulate homologous recombination (HR) repair pathways to site-specifically insert a transgene, a HR repair DNA vector (also referred to as a donor DNA) (SEQ ID NO: 97) was constructed as illustrated in FIG. 4 using standard molecular biology techniques and co-transformed with a long guide RNA expression cassette, comprising a variable targeting domain corresponding to the LIGCas-3 genomic target site, and a Cas9 endonuclease expression cassette into immature maize embryos as described in Example 2.

Maize embryos co-transformed with the HR repair DNA vector and LIG3-4 homing endonuclease (see Example 9) targeting the same genomic target site as LIGCas-3 served as a positive control. Since successful delivery of the HR repair DNA vector confers bialaphos herbicide resistance, callus events containing putative HR-mediated transgenic insertions were selected by placing the callus on herbicide containing media. After selection, stable callus events were sampled, total genomic DNA extracted, and using the primer pairs shown in FIG. 5 (corresponding to SEQ ID NOs: 98-101), PCR amplification was carried out at both possible transgene genomic DNA junctions to identify putative HR-mediated transgenic insertions. The resulting amplifications were sequenced for confirmation.

Sequence confirmed PCR amplifications indicating site-specific transgene insertion for the guide RNA/Cas system were detected for 37 out of 384 stable transformants with 15 containing amplifications across both transgene genomic DNA junctions indicating near perfect site-specific transgene insertion. The LIG3-4 homing endonuclease positive control yielded PCR amplifications indicating site-specific transgene insertion for 3 out of 192 stable transformants with 1 containing amplifications across both transgene genomic DNA junctions. The data clearly demonstrates that maize chromosomal loci cleaved with the maize optimized guide RNA/Cas system described herein can be used to stimulate HR repair pathways to site-specifically insert transgenes at frequencies greater than the LIG3-4 homing endonuclease.

Example 6

Guide RNA/Cas Endonuclease System Transformed Together on a Single Vector Results in Greater Recovery of Imperfect Non-Homologous End-Joining Mutations To evaluate different delivery methods for the maize optimized guide RNA/Cas endonuclease system described herein, the recovery of NHEJ mutations when the guide RNA/Cas expression cassettes were either co-transformed as separate DNA vectors as in Examples 2, 3, 4 and 5 or transformed as a single vector DNA (comprising both guide RNA and Cas endonuclease expression cassettes, as shown in FIG. 1C) was examined.

The long guide RNA expression cassette for LIGCas-3 and the Cas9 expression cassette were consolidated onto a single vector DNA (FIG. 1 C, SEQ ID NO: 102) by standard molecular biology techniques and transformed into immature Hi-II maize embryos as described in Examples 10 and 11 by particle-mediated delivery. Hi-II embryos co-transformed with the Cas9 and LIGCas-3 long guide RNA expression cassettes served as a positive control while embryos transformed with only the Cas9 expression cassette served as a negative control. Deep sequencing for NHEJ mutations was performed as described in Example 2.

As shown in Table 8 below, the frequency of NHEJ mutations recovered when the Cas endonuclease and long guide RNA expression cassettes were delivered together as a single vector DNA was approximately 2-fold greater than that observed from the equivalent co-transformation experiment. This indicates that delivery of the guide RNA/Cas system expression cassettes together on a single vector DNA results in a greater recovery of imperfect non-homologous end-joining mutations.

TABLE 8

Percent (%) mutant reads at the maize Liguleless 1 target locus produced by a guide RNA/Cas system with Cas9 and guide RNA expression cassettes combined into one DNA vector versus two separate DNA vectors.

| System | Total Number of Reads | Number of Mutant Reads | % Mutant Reads |
|---|---|---|---|
| Cas9 Only Control | 1,519,162 | 97 | 0.01% |
| LIGCas-3 guide/Cas9 (Two vector DNAs) | 1,515,0607 | 36,346 | 2.40% |
| LIGCas-3 guide/Cas9 (Single vector DNA) | 1,860,031 | 105,854 | 5.69% |

Example 7

Delivery Methods for Plant Genome Editing Using the Guide RNA/Cas Endonuclease System This example describes methods to deliver or maintain and express the Cas9 endonuclease and guide RNA (or individual crRNA and tracrRNAs) into, or within plants, respectively, to enable directed DNA modification or gene insertion via homologous recombination. More specifically this example describes a variety of methods which include, but are not limited to, delivery of the Cas9 endonuclease as a DNA, RNA (5-capped and polyadenylated) or protein molecule. In addition, the guide RNA may be delivered as a DNA or RNA molecule.

Shown in Example 2, a high mutation frequency was observed when Cas9 endonuclease and guide RNA were delivered as DNA vectors by biolistic transformation of immature corn embryos. Other embodiments of this disclosure can be to deliver the Cas9 endonuclease as a DNA, RNA or protein and the guide RNA as a DNA or RNA molecule or as a duplex crRNA/tracrRNA molecule as RNA or DNA or a combination. Various combinations of Cas9 endonuclease, guide RNA and crRNA/tracrRNA delivery methods can be, but are not limited to, the methods shown in Table 9.

TABLE 9

Various combinations of delivery of the cas9 endonuclease, guide RNA or cRNA + tracrRNA.

| combination | Components delivered. (Delivery method is shown between brackets) |
|---|---|
| 1 | Cas9 (DNA vector), guide RNA (DNA vector) |
| 2 | Cas9 (DNA vector), guide RNA (RNA) |
| 3 | Cas9 (RNA), guide RNA (DNA) |
| 4 | Cas9 (RNA), guide RNA (RNA) |
| 5 | Cas9 (Protein), guide RNA (DNA) |
| 6 | Cas9 (Protein), guide RNA (RNA) |
| 7 | Cas9 (DNA vector), crRNA (DNA), tracrRNA (DNA) |
| 8 | Cas9 (DNA vector), crRNA (RNA), tracrRNA (DNA) |
| 9 | Cas9 (DNA vector), crRNA (RNA), tracrRNA (RNA) |
| 10 | Cas9 (DNA vector) crRNA (DNA), tracrRNA (RNA) |
| 11 | Cas9 (RNA), crRNA (DNA), tracrRNA (DNA) |
| 12 | Cas9 (RNA), crRNA (RNA), tracrRNA (DNA) |
| 13 | Cas9 (RNA), crRNA (RNA), tracrRNA (RNA) |
| 14 | Cas9 (RNA), crRNA (DNA), tracrRNA (RNA) |

TABLE 9-continued

Various combinations of delivery of the cas9 endonuclease, guide RNA or cRNA + tracrRNA.

| combination | Components delivered. (Delivery method is shown between brackets) |
|---|---|
| 15 | Cas9 (Protein), crRNA (DNA), tracrRNA (DNA) |
| 16 | Cas9 (Protein), crRNA (RNA), tracrRNA (DNA) |
| 17 | Cas9 (Protein), crRNA (RNA), tracrRNA 18(RNA) |
| 18 | Cas9 (Protein), crRNA (DNA), tracrRNA (RNA) |

Delivery of the Cas9 (as DNA vector) and guide RNA (as DNA vector) example (Table 9, combination1) can also be accomplished by co-delivering these DNA cassettes on a single or multiple *Agrobacterium* vectors and transforming plant tissues by *Agrobacterium* mediated transformation. In addition, a vector containing a constitutive, tissue-specific or conditionally regulated Cas9 gene can be first delivered to plant cells to allow for stable integration into the plant genome to establish a plant line that contains only the Cas9 gene in the plant genome. In this example, single or multiple guide RNAs, or single or multiple crRNA and a tracrRNA can be delivered as either DNA or RNA, or combination, to the plant line containing the genome-integrated version of the Cas9 gene for the purpose of generating mutations or promoting homologous recombination when HR repair DNA vectors for targeted integration are co-delivered with the guide RNAs. As extension of this example, plant line containing the genome-integrated version of the Cas9 gene and a tracrRNA as a DNA molecule can also be established. In this example single or multiple crRNA molecules can be delivered as RNA or DNA to promote the generation of mutations or to promote homologous recombination when HR repair DNA vectors for targeted integration are co-delivered with crRNA molecule(s) enabling the targeted mutagenesis or homologous recombination at single or multiple sites in the plant genome.

Example 8

Components of the Guide RNA/Cas Endonuclease System Delivered Directly as RNA in Plants This example illustrates the use of the methods as described in Table 9 configuration of Example 7 [Cas9 (DNA vector), guide RNA (RNA)] for modification or mutagenesis of chromosomal loci in plants. The maize optimized Cas9 endonuclease expression cassette described in Example 1 was co-delivered by particle gun as described in Example 2 along with single stranded RNA molecules (synthesized by Integrated DNA Technologies, Inc.) constituting a short guide RNA targeting the maize locus and sequence shown in Table 10. Embryos transformed with only the Cas9 expression cassette or short guide RNA molecules served as negative controls. Seven days post-bombardment, the immature embryos were harvested and analyzed by deep sequencing for NHEJ mutations as described in Example 2. Mutations not present in the negative controls were found at the site (FIG. 6, corresponding to SEQ ID NOs: 104-110). These mutations were similar to those found in Examples 2, 3, 4 and 6. This data indicates that component(s) of the maize optimized guide RNA/Cas endonuclease system described herein may be delivered directly as RNA.

TABLE 10

Maize genomic target site and location for short guide RNA delivered as RNA.

| Locus | Location | Guide RNA Used | Designation | Maize Target Site | PAM Sequence | SEQ ID NO |
|---|---|---|---|---|---|---|
| 55 | Chr. 1: 51.78 cM | Short | 55CasRNA-1 | TGGGCAGGTCTCACGACGGT | TGG | 103 |

Example 9

Creation of Rare Cutting Engineered Meganucleases
LIG3-4 Meganuclease and LIG3-4 Intended Recognition Sequence An endogenous maize genomic target site comprising the LIG3-4 intended recognition sequence (SEQ ID NO: 111) was selected for design of a rare-cutting double-strand break inducing agent (SEQ ID NO: 112) as described in US patent publication 2009-0133152 A1 (published May 21, 2009). The LIG3-4 intended recognition sequence is a 22 bp polynucleotide having the following sequence:

(SEQ ID NO: 111)
ATATACCTCACACGTACGCGTA.

MS 26++ Meganuclease

An endogenous maize genomic target site designated "TS-MS26" (SEQ ID NO: 113) was selected for design of a custom double-strand break inducing agent MS26++ as described in U.S. patent application Ser. No. 13/526,912 filed Jun. 19, 2012). The TS-MS26 target site is a 22 bp polynucleotide positioned 62 bps from the 5' end of the fifth exon of the maize MS26 gene and having the following sequence: gatggtgacgtac^gtgccctac (SEQ ID NO: 113). The double strand break site and overhang region is underlined, the enzyme cuts after C13, as indicated by the ^. Plant optimized nucleotide sequences for an engineered endonuclease (SEQ ID NO: 114) encoding an engineered MS26++ endonuclease were designed to bind and make double-strand breaks at the selected TS-MS26 target site.

Example 10

Transformation of Maize Immature Embryos

Transformation can be accomplished by various methods known to be effective in plants, including particle-mediated delivery, *Agrobacterium*-mediated transformation, PEG-mediated delivery, and electroporation.

a. Particle-Mediated Delivery

Transformation of maize immature embryos using particle delivery is performed as follows. Media recipes follow below.

The ears are husked and surface sterilized in 30% Clorox bleach plus 0.5% Micro detergent for 20 minutes, and rinsed two times with sterile water. The immature embryos are isolated and placed embryo axis side down (scutellum side up), 25 embryos per plate, on 560Y medium for 4 hours and then aligned within the 2.5-cm target zone in preparation for bombardment. Alternatively, isolated embryos are placed on 560 L (Initiation medium) and placed in the dark at temperatures ranging from 26° C. to 37° C. for 8 to 24 hours prior to placing on 560Y for 4 hours at 26° C. prior to bombardment as described above.

Plasmids containing the double strand brake inducing agent and donor DNA are constructed using standard molecular biology techniques and co-bombarded with plasmids containing the developmental genes ODP2 (AP2 domain transcription factor ODP2 (Ovule development protein 2); US20090328252 A1) and Wushel (US2011/0167516).

The plasmids and DNA of interest are precipitated onto 0.6 μm (average diameter) gold pellets using a water-soluble cationic lipid transfection reagent as follows. DNA solution is prepared on ice using 1 μg of plasmid DNA and optionally other constructs for co-bombardment such as 50 ng (0.5 μl) of each plasmid containing the developmental genes ODP2 (AP2 domain transcription factor ODP2 (Ovule development protein 2); US20090328252 A1) and Wushel. To the pre-mixed DNA, 20 μl of prepared gold particles (15 mg/ml) and 5 μl of the a water-soluble cationic lipid transfection reagent is added in water and mixed carefully. Gold particles are pelleted in a microfuge at 10,000 rpm for 1 min and supernatant is removed. The resulting pellet is carefully rinsed with 100 ml of 100% EtOH without resuspending the pellet and the EtOH rinse is carefully removed. 105 μl of 100% EtOH is added and the particles are resuspended by brief sonication. Then, 10 μl is spotted onto the center of each macrocarrier and allowed to dry about 2 minutes before bombardment.

Alternatively, the plasmids and DNA of interest are precipitated onto 1.1 μm (average diameter) tungsten pellets using a calcium chloride ($CaCl_2$)) precipitation procedure by mixing 100 μl prepared tungsten particles in water, 10 μl (1 μg) DNA in Tris EDTA buffer (1 μg total DNA), 100 μl 2.5 M CaCl2, and 10 μl 0.1 M spermidine. Each reagent is added sequentially to the tungsten particle suspension, with mixing. The final mixture is sonicated briefly and allowed to incubate under constant vortexing for 10 minutes. After the precipitation period, the tubes are centrifuged briefly, liquid is removed, and the particles are washed with 500 ml 100% ethanol, followed by a 30 second centrifugation. Again, the liquid is removed, and 105 μl 100% ethanol is added to the final tungsten particle pellet. For particle gun bombardment, the tungsten/DNA particles are briefly sonicated. 10 μl of the tungsten/DNA particles is spotted onto the center of each macrocarrier, after which the spotted particles are allowed to dry about 2 minutes before bombardment.

The sample plates are bombarded at level #4 with a Biorad Helium Gun. All samples receive a single shot at 450 PSI, with a total of ten aliquots taken from each tube of prepared particles/DNA.

Following bombardment, the embryos are incubated on 560P (maintenance medium) for 12 to 48 hours at temperatures ranging from 26 C to 37 C, and then placed at 26 C. After 5 to 7 days the embryos are transferred to 560R selection medium containing 3 mg/liter Bialaphos, and subcultured every 2 weeks at 26 C. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to a lighted culture room. Approximately 7-10 days later, developing plantlets are transferred to 272V hormone-free medium in tubes for 7-10 days until plantlets are well established. Plants are then transferred to inserts in flats (equivalent to a 2.5" pot) containing potting soil and grown for 1 week in a growth chamber, subsequently grown an additional 1-2 weeks in the greenhouse, then transferred to Classic 600 pots (1.6 gallon) and grown to maturity. Plants are monitored and scored for transformation efficiency, and/or modification of regenerative capabilities.

Initiation medium (560 L) comprises 4.0 g/l N6 basal salts (SIGMA C-1416), 1.0 ml/l Eriksson's Vitamin Mix (1000× SIGMA-1511), 0.5 mg/l thiamine HCl, 20.0 g/l sucrose, 1.0 mg/l 2,4-D, and 2.88 g/l L-proline (brought to volume with D-I H2O following adjustment to pH 5.8 with KOH); 2.0 g/l Gelrite (added after bringing to volume with D-I H2O); and 8.5 mg/l silver nitrate (added after sterilizing the medium and cooling to room temperature).

Maintenance medium (560P) comprises 4.0 g/l N6 basal salts (SIGMA C-1416), 1.0 ml/l Eriksson's Vitamin Mix (1000×SIGMA-1511), 0.5 mg/l thiamine HCl, 30.0 g/l sucrose, 2.0 mg/l 2,4-D, and 0.69 g/l L-proline (brought to volume with D-I H2O following adjustment to pH 5.8 with KOH); 3.0 g/l Gelrite (added after bringing to volume with D-I H2O); and 0.85 mg/l silver nitrate (added after sterilizing the medium and cooling to room temperature).

Bombardment medium (560Y) comprises 4.0 g/l N6 basal salts (SIGMA C-1416), 1.0 ml/l Eriksson's Vitamin Mix (1000×SIGMA-1511), 0.5 mg/l thiamine HCl, 120.0 g/l sucrose, 1.0 mg/l 2,4-D, and 2.88 g/l L-proline (brought to volume with D-I H2O following adjustment to pH 5.8 with KOH); 2.0 g/l Gelrite (added after bringing to volume with D-I H2O); and 8.5 mg/l silver nitrate (added after sterilizing the medium and cooling to room temperature).

Selection medium (560R) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, and 2.0 mg/l 2,4-D (brought to volume with D-I H2O following adjustment to pH 5.8 with KOH); 3.0 g/l Gelrite (added after bringing to volume with D-I H2O); and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I H2O) (Murashige and Skoog (1962) Physiol. Plant. 15:473), 100 mg/l myo-inositol, 0.5 mg/l zeatin, 60 g/l sucrose, and 1.0 ml/l of 0.1 mM abscisic acid (brought to volume with polished D-I H2O after adjusting to pH 5.6); 3.0 g/l Gelrite (added after bringing to volume with D-I H2O); and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I H2O), 0.1 g/l myo-inositol, and 40.0 g/l sucrose (brought to volume with polished D-I H2O after adjusting pH to 5.6); and 6 g/l bacto-agar (added after bringing to volume with polished D-I H2O), sterilized and cooled to 60° C.

b. *Agrobacterium*-Mediated Transformation

*Agrobacterium*-mediated transformation was performed essentially as described in Djukanovic et al. (2006) *Plant Biotech J* 4:345-57. Briefly, 10-12 day old immature embryos (0.8-2.5 mm in size) were dissected from sterilized kernels and placed into liquid medium (4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.690 g/L L-proline, 68.5 g/L sucrose, 36.0 g/L glucose, pH 5.2). After embryo collection, the medium was replaced with 1 ml *Agrobacterium* at a concentration of 0.35-0.45 OD550. Maize embryos were incubated with *Agrobacterium* for 5 min at room temperature, then the mixture was poured onto a media plate containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.690 g/L L-proline, 30.0 g/L sucrose, 0.85 mg/L silver nitrate, 0.1 nM acetosyringone, and 3.0 g/L Gelrite, pH 5.8. Embryos were incubated axis down, in the dark for 3 days at 20° C., then incubated 4 days in the dark at 28° C., then transferred onto new media plates containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.69 g/L L-proline, 30.0 g/L sucrose, 0.5 g/L MES buffer, 0.85 mg/L silver nitrate, 3.0 mg/L Bialaphos, 100 mg/L carbenicillin, and 6.0 g/L agar, pH 5.8. Embryos were subcultured every three weeks until transgenic events were identified. Somatic embryogenesis was induced by transferring a small amount of tissue onto regeneration medium (4.3 g/L MS salts (Gibco 11117), 5.0 ml/L MS Vitamins Stock Solution, 100 mg/L myo-inositol, 0.1 µM ABA, 1 mg/L IAA, 0.5 mg/L zeatin, 60.0 g/L sucrose, 1.5 mg/L Bialaphos, 100 mg/L carbenicillin, 3.0 g/L Gelrite, pH 5.6) and incubation in the dark for two weeks at 28° C. All material with visible shoots and roots were transferred onto media containing 4.3 g/L MS salts (Gibco 11117), 5.0 ml/L MS Vitamins Stock Solution, 100 mg/L myo-inositol, 40.0 g/L sucrose, 1.5 g/L Gelrite, pH 5.6, and incubated under artificial light at 28° C. One week later, plantlets were moved into glass tubes containing the same medium and grown until they were sampled and/or transplanted into soil.

Example 11

Transient Expression of BBM Enhances Transformation

Parameters of the transformation protocol can be modified to ensure that the BBM activity is transient. One such method involves precipitating the BBM-containing plasmid in a manner that allows for transcription and expression, but precludes subsequent release of the DNA, for example, by using the chemical PEI. In one example, the BBM plasmid is precipitated onto gold particles with PEI, while the transgenic expression cassette (UBI::moPAT~GFPm::PinII; moPAT is the maize optimized PAT gene) to be integrated is precipitated onto gold particles using the standard calcium chloride method.

Briefly, gold particles were coated with PEI as follows. First, the gold particles were washed. Thirty-five mg of gold particles, 1.0 in average diameter (A.S.I. #162-0010), were weighed out in a microcentrifuge tube, and 1.2 ml absolute EtOH was added and vortexed for one minute. The tube was incubated for 15 minutes at room temperature and then centrifuged at high speed using a microfuge for 15 minutes at 4° C. The supernatant was discarded and a fresh 1.2 ml aliquot of ethanol (EtOH) was added, vortexed for one minute, centrifuged for one minute, and the supernatant again discarded (this is repeated twice). A fresh 1.2 ml aliquot of EtOH was added, and this suspension (gold particles in EtOH) was stored at −20° C. for weeks. To coat particles with polyethylimine (PEI; Sigma #P3143), 250 µl of the washed gold particle/EtOH mix was centrifuged and the EtOH discarded. The particles were washed once in 100 µl ddH2O to remove residual ethanol, 250 µl of 0.25 mM PEI was added, followed by a pulse-sonication to suspend the particles and then the tube was plunged into a dry ice/EtOH bath to flash-freeze the suspension, which was then lyophilized overnight. At this point, dry, coated particles could be stored at −80° C. for at least 3 weeks. Before use, the particles were rinsed 3 times with 250 µl aliquots of 2.5 mM HEPES buffer, pH 7.1, with 1× pulse-sonication, and then a quick vortex before each centrifugation. The particles were then suspended in a final volume of 250 µl HEPES buffer. A 25 µl aliquot of the particles was added to fresh tubes before attaching DNA. To attach uncoated DNA, the particles were pulse-sonicated, then 1 µg of DNA (in 5 µl water) was added, followed by mixing by pipetting up and down a few times with a Pipetteman and incubated for 10 minutes. The particles were spun briefly (i.e. 10 seconds), the supernatant removed, and 60 µl EtOH added. The particles with PEI-precipitated DNA-1 were washed twice in 60 µl of EtOH. The particles were centrifuged, the supernatant discarded, and the particles were resuspended in 45 µl water. To attach the second DNA (DNA-2), precipitation using a water-soluble cationic lipid transfection reagent was used. The 45 µl of particles/DNA-1 suspension was briefly sonicated, and then 5 µl of 100 ng/µl of DNA-2 and 2.5 µl of a water-soluble cationic lipid transfection reagent were added. The solution was placed on a rotary shaker for 10 minutes, centrifuged at 10,000 g for 1 minute. The supernatant was removed, and the particles resuspended in 60 µl of EtOH. The solution was spotted onto macrocarriers and the gold particles onto which DNA-1 and DNA-2 had been sequentially attached were delivered into scutellar cells of 10 DAP Hi-II immature embryos using a standard protocol for the PDS-1000. For this experiment, the DNA-1 plasmid contained a UBI::RFP::pinII expression cassette, and DNA-2 contained a UBI::CFP::pinII expression cassette. Two days after bombardment, transient expression of both the CFP and RFP fluorescent markers was observed as numerous red & blue cells on the surface of the immature embryo. The embryos were then placed on non-selective culture medium and allowed to grow for 3 weeks before scoring for stable colonies. After this 3-week period, 10 multicellular, stably-expressing blue colonies were observed, in comparison to only one red colony. This demonstrated that PEI-precipitation could be used to effectively introduce DNA for transient expression while dramatically reducing integration of the PEI-introduced DNA and thus reducing the recovery of RFP-expressing transgenic events. In this manner, PEI-precipitation can be used to deliver transient expression of BBM and/or WUS2.

For example, the particles are first coated with UBI::BBM::pinII using PEI, then coated with UBI::moPAT~YFP using a water-soluble cationic lipid transfection reagent, and then bombarded into scutellar cells on the surface of immature embryos. PEI-mediated precipitation results in a high frequency of transiently expressing cells on the surface of the immature embryo and extremely low frequencies of recovery of stable transformants. Thus, it is expected that the PEI-precipitated BBM cassette expresses transiently and stimulates a burst of embryogenic growth on the bombarded surface of the tissue (i.e. the scutellar surface), but this plasmid will not integrate. The PAT~GFP plasmid released from the Ca++/gold particles is expected to integrate and express the selectable marker at a frequency that results in substantially improved recovery of transgenic events. As a control treatment, PEI-precipitated particles containing a UBI::GUS::pinII (instead of BBM) are mixed with the PAT~GFP/Ca++ particles. Immature embryos from both treatments are moved onto culture medium containing 3 mg/l bialaphos. After 6-8 weeks, it is expected that GFP+, bialaphos-resistant calli will be observed in the PEI/BBM treatment at a much higher frequency relative to the control treatment (PEI/GUS).

As an alternative method, the BBM plasmid is precipitated onto gold particles with PEI, and then introduced into scutellar cells on the surface of immature embryos, and subsequent transient expression of the BBM gene elicits a rapid proliferation of embryogenic growth. During this period of induced growth, the explants are treated with *Agrobacterium* using standard methods for maize (see Example 1), with T-DNA delivery into the cell introducing a transgenic expression cassette such as UBI::moPAT~GFPm::pinII. After co-cultivation, explants are allowed to recover on normal culture medium, and then are moved onto culture medium containing 3 mg/l bialaphos. After 6-8 weeks, it is expected that GFP+, bialaphos-resistant calli will be observed in the PEI/BBM treatment at a much higher frequency relative to the control treatment (PEI/GUS).

It may be desirable to "kick start" callus growth by transiently expressing the BBM and/or WUS2 polynucleotide products. This can be done by delivering BBM and WUS2 5-capped polyadenylated RNA, expression cassettes containing BBM and WUS2 DNA, or BBM and/or WUS2 proteins. All of these molecules can be delivered using a biolistics particle gun. For example 5-capped polyadenylated BBM and/or WUS2 RNA can easily be made in vitro using Ambion's mMessage mMachine kit. RNA is co-delivered along with DNA containing a polynucleotide of interest and a marker used for selection/screening such as Ubi::moPAT~GFPm::PinII. It is expected that the cells receiving the RNA will immediately begin dividing more rapidly and a large portion of these will have integrated the agronomic gene. These events can further be validated as being transgenic clonal colonies because they will also express the PAT~GFP fusion protein (and thus will display green fluorescence under appropriate illumination). Plants regenerated from these embryos can then be screened for the presence of the polynucleotide of interest.

Example 12

DNA Constructs to Test the Guide RNA/Cas Endonuclease System for Soybean Genome Modifications To test if a guide RNA/Cas endonuclease system, similar to that described in Example 1 for maize, is functional in a dicot such as soybean, a Cas9 (SO) gene (SEQ ID NO:115) soybean codon optimized from *Streptococcus pyogenes* M1 GAS (SF370) was expressed with a strong soybean constitutive promoter GM-EF1A2 (US patent application 20090133159 (SEQ ID NO: 116). A simian vacuolating virus 40 (SV40) large T-antigen nuclear localization signal (SEQ ID NO:117), representing the amino acid molecules of PKKKRKV (with a linker SRAD (SRADPKKKRKV), was added to the carboxyl terminus of the codon optimized Cas9 to facilitate transporting the codon optimized Cas9 protein (SEQ ID NO:118) to the nucleus. The codon optimized Cas9 gene was synthesized as two pieces by GenScript USA Inc. (Piscataway, NJ) and cloned in frame downstream of the GM-EF1A2 promoter to make DNA construct QC782 shown in FIG. 7 (SEQ ID NO:119).

Plant U6 RNA polymerase III promoters have been cloned and characterized from such as *Arabidopsis* and *Medicago truncatula* (Waibel and Filipowicz, NAR 18:3451-3458 (1990); Li et al., J. Integrat. Plant Biol. 49:222-229 (2007); Kim and Nam, Plant Mol. Biol. Rep. 31:581-593 (2013); Wang et al., RNA 14:903-913 (2008)). Soybean U6 small nuclear RNA (snRNA) genes were identified herein by searching public soybean variety Williams82 genomic sequence using *Arabidopsis* U6 gene coding sequence. Approximately 0.5 kb genomic DNA sequence upstream of the first G nucleotide of a U6 gene was selected to be used as a RNA polymerase III promoter for example, GM-U6-13.1 promoter (SEQ ID NO:120), to express guide the 20 bp variable targeting domain of the guide RNA started with a G residue required by RNA polymerase III and was followed in the soybean genome by a 3 bp PAM motif (Table 11). The chromosome positions of the soybean genomic targets sites in close proximity to the PAM sequences were determined by blast searching the public soybean variety Williams82 genomic sequence. The soybean genomic target sites DD20CR1 (SEQ ID NO: 125), DD20CR2 (SEQ ID NO: 126), and DD43CR1 (SEQ ID NO: 127) were identified as all unique in soybean genome while a second identical 23 bp genomic target site DD43CR2 (SEQ ID NO: 128) was found at Gm06:12072339-12072361 so there are two potential cleavage sites targeted by DD43CR2 guide RNA. Both DD43CR1 and DD43CR2 are complementary strand sequences indicated by "c" after the positions.

TABLE 11

Soybean genomic target sites for a guide RNA/Cas endonuclease system.

| Chromosome | Positions | Designation | Genomic Target Sites | PAM |
|---|---|---|---|---|
| Gm04, 114.13 cM | 45936311-45936333 | DD20CR1 | GGAACTGACACACGACATGA | TGG |
| | 45936324-45936346 | DD20CR2 | GACATGATGGAACGTGACTA | AGG |
| Gm04, 111.95 cM | 45731921-45731943c | DD43CR1 | GTCCCTTGTACTTGTACGTA | CGG |
| | 45731895-45731917c | DD43CR2 | GTATTCTAGAAAAGAGGAAT | TGG |

RNA to direct Cas9 nuclease to designated genomic site. The guide RNA coding sequence was 76 bp long (FIG. 8B) and comprised a 20 bp variable targeting domain from a chosen soybean genomic target site on the 5' end and a tract of 4 or more T residues as a transcription terminator on the 3' end. (SEQ ID NO:121, FIG. 8 B). The first nucleotide of the 20 bp variable targeting domain was a G residue to be used by RNA polymerase III for transcription. The U6 gene promoter and the complete guide RNA was synthesized and then cloned into an appropriate vector to make, for example, DNA construct QC783 shown in FIG. 8 A (SEQ ID NO:122). Other soybean U6 homologous genes promoters were similarly cloned and used for small RNA expression.

Since the Cas9 endonuclease and the guide RNA need to form a protein/RNA complex to mediate site-specific DNA double strand cleavage, the Cas9 endonuclease and guide RNA must be expressed in same cells. To improve their co-expression and presence, the Cas9 endonuclease and guide RNA expression cassettes were linked into a single DNA construct, for example, QC815 in FIG. 9 A (SEQ ID NO:123), which was then used to transform soybean cells to test the soybean optimized guide RNA/Cas system for genome modification. Similar DNA constructs were made to target different genomic sites using guide RNAs containing different target sequences.

Example 13

Selection of Soybean Genomic Sites to be Cleaved by the Guide RNA/Cas Endonuclease System A region of the soybean chromosome 4 (Gm04) was selected to test if the soybean optimized guide RNA/Cas endonuclease system could recognize, cleave, and mutate soybean chromosomal DNA through imprecise non-homologous end-joining (NHEJ) repair. Two genomic target sites were selected one close to a predicted gene Glyma04g39780.1 at 114.13 cM herein named DD20 locus (FIG. 10A) and another close to Glyma04 g39550.1 at 111.95 cM herein named DD43 locus (FIG. 10B). Each of Guide RNA expression cassette comprising a variable targeting domain targeting one of DD20CR1, DD20CR2, DD43CR2 genomic target sites were similarly constructed and linked to the soybean Cas9 expression cassette to make DNA constructs QC817, QC818, and QC816 that are similar to QC815 in FIG. 9 A (SEQ ID NO:123) except for the 20 bp variable targeting domain of the guide RNA Since up to six continuous mismatches in the 5' regions of the genomic target site (protospacer) with the 20 bp variable targeting domain can be tolerated, i.e., a continuous stretch of 14 base pairs between the variable targeting domain and the crRNA sequence proximate to the PAM is necessarily enough for efficient targets cleavage any 23 bp genomic DNA sequence following the pattern N(20)NGG can be selected as a target site for the guide RNA/Cas endonuclease system. The last NGG is the PAM sequence that should not be included in the 20 bp variable targeting domain of the guide RNA. If the first N is not endogenously a G residue it must be replaced with a G residue in guide RNA target sequence to accommodate RNA polymerase III, which should not sacrifice recognition specificity of the target site by the guide RNA.

Example 14

Delivery of the Guide RNA/Cas Endonuclease System DNA to Soybean by Transient Transformation The soybean optimized Cas9 endonuclease and guide RNA expression cassettes were delivered to young soybean somatic embryos in the form of embryogenic suspension cultures by particle gun bombardment. Soybean embryogenic suspension cultures were induced as follows. Cotyledons (~3 mm in length) were dissected from surface sterilized, immature seeds and were cultured for 6-10 weeks in the light at 26° C. on a Murashige and Skoog (MS) media containing 0.7% agar and supplemented with 10 mg/ml 2,4-D (2,4-Dichlorophenoxyacetic acid). Globular stage somatic embryos, which produced secondary embryos, were then excised and placed into flasks containing liquid MS medium supplemented with 2,4-D (10 mg/ml) and cultured in the light on a rotary shaker. After repeated selection for clusters of somatic embryos that multiplied as early, globular staged embryos, the soybean embryogenic suspension cultures were maintained in 35 ml liquid media on a rotary shaker, 150 rpm, at 26° C. with fluorescent lights on a 16:8 hour day/night schedule. Cultures were subcultured every two weeks by inoculating approximately 35 mg of tissue into 35 ml of the same fresh liquid MS medium.

Soybean embryogenic suspension cultures were then transformed by the method of particle gun bombardment using a DuPont Biolistic™ PDS1000/HE instrument (Bio-Rad Laboratories, Hercules, CA). To 50 µl of a 60 mg/ml 1.0 mm gold particle suspension were added (in order): 30 µl of 30 ng/µl QC815 DNA fragment U6-13.1:DD43CR1+ EF1A2:CAS9 as an example, 20 µl of 0.1 M spermidine, and 25 µl of 5 M $CaCl_2$. The particle preparation was then agitated for 3 minutes, spun in a centrifuge for 10 seconds and the supernatant removed. The DNA-coated particles were then washed once in 400 µl 100% ethanol and resuspended in 45 µl of 100% ethanol. The DNA/particle suspension was sonicated three times for one second each. Then 5 µl of the DNA-coated gold particles was loaded on each macro carrier disk.

Approximately 100 mg of a two-week-old suspension cultures were placed in an empty 60×15 mm Petri dish and the residual liquid removed from the tissue with a pipette. Membrane rupture pressure was set at 1100 psi and the chamber was evacuated to a vacuum of 28 inches mercury. The tissue was placed approximately 3.5 inches away from the retaining screen and bombarded once. The tissue clumps were rearranged and bombarded another time. Minimum amount of liquid MS media without 2,4-D supplement was added to the tissue to prevent the cultures from drying or overgrowing. The 60×15 mm Petri dish was sealed in a 100×25 mm Petri dish containing agar solid MS media to as another measure to keep the tissues from drying up. The tissues were harvested seven days after and genomic DNA was extracted for PCR analysis.

Example 15

Analysis of Guide RNA/Cas Endonuclease System Mediated Site-Specific NHEJ by Deep Sequencing To evaluate DNA double strand cleavage at a soybean genomic target site mediated by the guide RNA/Cas endonuclease system, a region of approximately 100 bp genomic DNA surrounding the target site was amplified by PCR and the PCR product was then sequenced to check mutations at the target site as results of NHEJs. The region was first amplified by 20 cycles of PCR with Phusion High Fidelity mastermix (New England Biolabs) from 100 ng genomic DNA using gene-specific primers that also contain adaptors and amplicon-specific barcode sequences needed for a second round PCR and subsequence sequence analysis. For examples, the first PCR for the four experiments listed in Table 2 were done using primers DD20-S3 (SEQ ID NO:133)/DD20-A (SEQ ID NO:134), DD20-S4 (SEQ ID NO:135)/DD20-A, DD43-S3 (SEQ ID NO:136)/DD43-A (SEQ ID NO:137) and DD43-S4 (SEQ ID NO:138)/DD43-A. One micro liter of the first round PCR products was further amplified by another 20 cycles of PCR using universal primers (SEQ ID NOs:140, 141) with Phusion High Fidelity mastermix. The resulting PCR products were separated on 1.5% agarose gel and the specific DNA bands were purified with Qiagen gel purification spin columns. DNA concentrations were measured with a DNA Bioanalyzer (Agilent) and equal molar amounts of DNA for up to 12 different samples each with specific barcode were mixed as one sample for Illumina deep sequencing analysis. Single read 100 nucleotide-length deep sequencing was performed at a DuPont core facility on a Illumnia's MiSeq Personal Sequencer with a 40% (v/v) spike of PhiX control v3 (Illumina, FC-110-3001) to off-set sequence bias.

Since the genomic target site is located in the middle of the ~100 bp long PCR amplicon (SEQ ID NOs: 142, 143, 144, 145), the 100 nucleotide-length deep sequencing is sufficient to cover the targets site region. A window of 10 nucleotides centered over the expected cleavage site, i.e., 3 bp upstream of the PAM, was selected for sequence analysis. Only those reads with one or more nucleotide indel arising within the 10 nucleotide window and not found in a similar level in negative controls were classified as NHEJ mutations. NHEJ mutant reads of different lengths but with the same mutation were counted into a single read and up to 10 most prevalent mutations were visually confirmed to be specific mutations before they were then used to calculate the % mutant reads based on the total analyzed reads containing specific barcode and forward primer.

The frequencies of NHEJ mutations revealed by deep sequencing for four target sites DD20CR1, DD20CR2, DD43CR1, DD43CR2 with one RNA polymerase III promoter GM-U6-13.1 are shown in Table 2. The visually confirmed most prevalent NHEJ mutations are shown in FIG. 11A-11D. The mutant sequences in FIG. 11A-11E are listed as SEQ ID NOs:147-201. The top row is the original reference sequence with the target site sequence underlined. Deletions in the mutated sequences are indicated by "---" while additions and replacements are indicated by bold letters. Total count of each mutation of different reads is given in the last column. Cas9 nuclease construct only, guide RNA construct only, and no DNA bombardment negative controls were similarly performed and analyzed but data not shown since no-specific mutations were detected. Other targets sites and guide RNAs were also tested with similar positive results and data not shown.

TABLE 12

Target site-specific mutations introduced by guide RNA/Cas endonuclease mediated NHEJ.

| Experiment | DNA | Mutant reads | Total reads | % Mutants |
|---|---|---|---|---|
| U6-13.1:DD20CR1 + EF1A2:CAS9 | QC817 | 339 | 710,339 | 0.048% |
| U6-13.1:DD20CR2 + EF1A2:CAS9 | QC818 | 419 | 693,483 | 0.060% |
| U6-13.1:DD43CR1 + EF1A2:CAS9 | QC815 | 489 | 682,207 | 0.072% |
| U6-13.1:DD43CR2 + EF1A2:CAS9 | QC816 | 917** | 539,681 | 0.170% |

**At least the top 15 reads are specific mutations but only the top 10 are counted in the table to be consistent with other experiments. If all top 15 mutations are counted, the total Mutant reads is 1080 and the % Mutants is 0.200%.

In conclusion, our data indicate that the soybean optimized guide RNA/Cas endonuclease system is able to effectively cleave soybean endogenous genomic DNA and create imperfect NHEJ mutations at the specified genomic target sites.

Example 16

The Guide RNA/Cas Endonuclease System Delivers Double-Strand Breaks (DBSs) to the Maize Epsps Locus Resulting in Desired Point Mutations Two maize optimized Cas9 endonucleases were developed and evaluated for their ability to introduce a double-strand break at a genomic target sequence. A first Cas9 endonuclease was as described in FIG. 1A (Example 2 and expression cassette SEQ ID NO:5). A second maize optimized Cas9 endonuclease (moCas9 endonuclease; SEQ ID NO:192) was supplemented with the SV40 nuclear localization signal by adding the signal coding sequence to the 5' end of the moCas9 coding sequence (FIG. 13). The plant moCas9 expression cassette was subsequently modified by the insertion of the ST-LS1 intron into the moCas9 coding sequence in order to enhance its expression in maize cells and to eliminate its expression in *E. coli* and *Agrobacterium*. The maize ubiquitin promoter and the potato proteinase inhibitor II gene terminator sequences complemented the moCas9 endonuclease gene designs. The structural elements of the moCas9 expression cassette are shown in FIG. 13 and its amino acid and nucleotide sequences are listed as SEQ ID Nos: 192 and 193.

A single guide RNA (sgRNA) expression cassette was essentially as described in Example 1 and shown in FIG. 1 B. It consists of the U6 polymerase III maize promoter (SEQ ID NO: 9) and its cognate U6 polymerase III termination sequences (TTTTTTTT). The guide RNA (SEQ ID NO: 194) comprised a 20 nucleotide variable targeting domain (nucleotide1-20 of SEQ ID NO: 194) followed by a RNA sequence capable of interacting with the double strand break inducing endonuclease.

A maize optimized Cas9 endonuclease target sequence (moCas9 target sequence) within the EPSPS codon sequence was complementary to the 20 nucleotide variable sequence of the guide sgRNA determined the site of the Cas9 endonuclease cleavage within the EPSPS coding sequence.

The moCAS9 target sequence (nucleotides 25-44 of SEQ ID NO:209) was synthesized and cloned into the guide RNA-Cas9 expression vector designed for delivery of the components of the guide RNA-Cas9 system to the BMS (Black Mexican Sweet) cells through *Agrobacterium*-mediated transformation. *Agrobacterium* T-DNA delivered also the yeast FLP site-specific recombinase and the WDV (wheat dwarf virus) replication-associated protein (replicase). Since the moCas9 target sequences were flanked by the FLP recombination targets (FRT), they were excised by FLP in maize cells forming episomal (chromosome-like) structures. Such circular DNA fragments were replicated by the WDV replicase (the origin of replication was embedded into the WDV promoter) allowing their recovery in *E. coli* cells. If the maize optimizedCas9 endonuclease made a double-strand break at the moCas9 target sequence, its repair might produce mutations. The procedure is described in detail in: Lyznik, L. A., Djukanovic, V., Yang, M. and Jones, S. (2012) Double-strand break-induced targeted mutagenesis in plants. In: *Transgenic plants: Methods and Protocols* (Dunwell, J. M. and Wetten, A. C. eds). New York Heidelberg Dordrecht London: Springer, pp. 399-416.

The guideRNA/Cas endonuclease systems using either one of the maize optimized Cas9 endonucleases described herein, generated double-strand breaks in the moCas9 target sequence (Table 13). Table 13 shows the percent of the moCas9 target sequences mutagenized in the maize BMS cells using the moCas9 endonuclease of SEQ ID NO: 192 or the maize optimized cas9 endonuclease described in FIG. 1A and expressed by the expression cassette of SEQ ID NO:5. Both guideRNA/Cas endonuclease systems generated double-strand breaks (as judged by the number of targeted mutagenesis events) ranging from 67 to 84% of the moCas9 target sequences available on episomal DNA molecules in maize BMS cells. A sample of mutagenized EPSPS target sequences is shown in FIG. 14. This observation indicates that the maize optimized Cas9 endonuclease described herein is functional in maize cells and efficiently generates double-strand breaks at the moCas9 target sequence.

TABLE 13

Percent of the moCas9 target sequences mutagenized in the maize BMS cells by maize optimized Cas9 endonucleases.

| Cas9 endonuclease version | # of moCas9 target sequences analyzed | # of intact moCas9 target sequences recovered | # of mutagenized moCas9 target sequences found | Percent mutagenesis (%) |
|---|---|---|---|---|
| SEQ ID NO: 193 (FIG. 13) | 81 | 13 | 68 | 84% |
| SEQ ID NO: 5 (FIG. 1A) | 93 | 31 | 62 | 67% |

In order to accomplish targeted genome editing of the maize chromosomal EPSPS gene, a polynucleotide modification template which provided genetic information for editing the EPSPS coding sequence was created (SEQ ID NO:195) and co-delivered with the guide RNA/Cas9 system components.

As shown in FIG. 12 A, B, the polynucleotide modification template comprised three nucleotide modifications (indicated by arrows) when compared to the EPSPS genomic sequence to be edited. These three nucleotide modifications are referred to as TIPS mutations as these nucleotide modifications result in the amino acid changes T-102 to I-102 and P-106 to S-106. The first point mutation results from the substitution of the C nucleotide in the codon sequence ACT with a T nucleotide, a second mutation results from the substitution of the T nucleotide on the same codon sequence ACT with a C nucleotide to form the isoleucine codon (ATC), the third point mutation results from the substitution of the first C nucleotide in the codon sequence CCA with a T nucleotide in order to form a serine codon, TCA. (FIG. 12 A, B). Both codon sequences were located within 9 nucleotides of each other as shown in SEQ ID NO: 196: atcgcaatgcggtca. The three nucleotide modifications are shown in bold. The nucleotides between the two codon sequences were homologous to the non-edited EPSPS gene on the epsps locus. The polynucleotide modification template further comprised DNA fragments of maize EPSPS genomic sequence that were used as homologous sequence for the EPSPS gene editing. The short arm of homologous sequence (HR1-FIG. 12 A, B) was 810 base pairs long and the long arm of homologous sequence (HR2-FIG. 12 A, B) was 2,883 base pairs long (SEQ ID NO: 195).

In this example, the EPSPS polynucleotide modification template was co-delivered using particle gun bombardment as a plasmid (see template vector 1, FIG. 15) together with the guide sgRNA expression cassette and a maize optimized-Cas9 endonuclease expression vector which contained the maize optimized Cas9 endonuclease expression cassette described in FIG. 1A (Example 1, SEQ ID NO:5) and also contained a moPAT selectable marker gene. Ten to eleven day-old immature embryos were placed, embryo-axis down, onto plates containing the N6 medium (Table 14) and incubated at 28 in for 4-6 hours before bombardment. The plates were placed on the third shelf from the bottom in the PDS-1000 apparatus and bombarded at 200 psi. Post-bombardment, embryos were incubated in the dark overnight at 28° C. and then transferred to plates containing the N6-2 media for 6-8 days at 28° C. The embryos were then transferred to plates containing the N6-3 media for three weeks, followed by transferring the responding callus to plates containing the N6-4 media for an additional three-week selection. After six total weeks of selection at 28, a small amount of selected tissue was transferred onto the MS regeneration medium and incubated for three weeks in the dark at 2800.

TABLE 14

Composition of Culture Media.

| Culture medium | Composition |
|---|---|
| N6 | 4.0 g/L $N_6$ Basal Salts (Sigma C-1416; Sigma-Aldrich Co., St. Louis, MO, USA), 1.0 ml/L Ericksson's Vitamin Mix (Sigma E-1511), 0.5 mg/L thiamine HCl, 190 g/L sucrose, 1.0 mg/L 2,4-dichlorophenoxyacetic acid (2,4-D), 2.88 g/L L-proline, 8.5 mg/L silver nitrate, 25 mg/L cefotaxime, and 6.36 g/L Sigma agar at pH 5.8 |
| N6-2 | 4.0 g/L $N_6$ Basal Salts (Sigma C-1416), 1.0 ml/L Ericksson's Vitamin Mix (Sigma E-1511), 0.5 mg/L thiamine HCl, 20 g/L sucrose, 1.0 mg/L 2,4-D, 2.88 g/L L-proline, 8.5 mg/L silver nitrate, 25 mg/L cefotaxime, and 8.5 g/L Sigma agar at pH 5.8 |
| N6-3 | 4.0 g/L $N_6$ Basal Salts (Sigma C-1416), 1.0 ml/L Ericksson's Vitamin Mix (Sigma E-1511), 0.5 mg/L thiamine HCl, 30 g/L sucrose, 1.5 mg/L 2,4-D, 0.69 g/L L-proline, 0.5 g/L 2-(N-morpholino)ethanesulphonic acid (MES) buffer, 0.85 mg/L silver nitrate, 5 mg/L glufosinate $NH_4$, and 8.0 g/L Sigma agar at pH 5.8 |
| N6-4 | 4.0 g/L $N_6$ Basal Salts (Sigma C-1416), 1.0 ml/L Ericksson's Vitamin Mix (Sigma E-1511), 0.5 mg/L thiamine HCl, 30 g/L sucrose, 1.5 mg/L 2,4-D, 0.69 g/L L-proline, 0.5 g/L MES buffer, 0.85 mg/L silver nitrate, 3 mg/L bialophos, and 8.0 g/L Sigma agar at pH 5.8 |
| MS | 4.3 g/L Murashige and Skoog (MS) salts (Gibco 11117; Gibco, Grand Island, NY), 5.0 ml/L MS Vitamins Stock Solution (Sigma M3900), 100 mg/L myo-inositol, 0.1 µmol abscisic acid (ABA), 1 mg/L indoleacetic acid (IAA), 0.5 mg/L zeatin, 60.0 g/L sucrose, 3.0 mg/L Bialaphos, and 8.0 g/L Sigma agar at pH 5.6 |

DNA was extracted by placing callus cell samples, two stainless-steel beads, and 450 ul of extraction buffer (250 mM NaCl, 200 mM Tris-HCl pH 7.4, 25 mM EDTA, 4.2 M Guanidine HCl) into each tube of a Mega titer rack. The rack was shaken in the Genogrinder at 1650 r.p.m. for 60 seconds and centrifuged at 3000×g for 20 min at 4° C. Three hundred µl of supernatant was transferred to the wells of the Unifilter 96-well DNA Binding GF/F Microplate (770-2810, Whatman, GE Healthcare). The plate was placed on the top of a Multi-well plate vacuum manifold (5017, Pall Life Sciences). A vacuum pressure was applied until the wells were completely dried. The vacuum filtration procedure was repeated one time with 100 ul extraction buffer and two times with 250 ul washing buffer (50 mM Tris-HCl pH 7.4, 200 mM NaCl, 70% ethanol). The residual ethanol was removed by placing the GF/F filter plate on an empty waste collection plate and centrifuged for 10 min at 3000×g. The DNA was eluted in 100 ul Elution Buffer (10 mM Tris-HCl, pH 8.3) and centrifuged at 3000×g for 1 min. For each sample, four PCR reactions were run. They included approximately 40 ng genomic DNA, 10 ul REDExtract-N-Amp PCR ReadyMix (R4775, Sigma-Aldrich Co.), and 5 picomoles of each primer in a total volume of 20 ul. Primer combinations for each PCR reaction are listed in the Table 15.

TABLE 15

Primer combinations for PCR reactions.

| PCR reaction | Primer sequence | SEQ ID NO: | PCR product |
|---|---|---|---|
| F-E2 | CCGAGGAGATCGTGCTGCA<br>CAATGGCCGCATTGCAGTTC | 197<br>198 | Template randomly integrated or gene editing event |
| F-T | CCGAGGAGATCGTGCTGCA<br>TGACCGCATTGCGATTCCAG | 199<br>200 | Wild-type EPSPS allele |
| H-T | TCCAAGTCGCTTTCCAACAGGATC<br>TGACCGCATTGCGATTCCAG | 201<br>202 | TIPS editing event |
| F-E3 | CCGAGGAGATCGTGCTGCA<br>ACCAAGCTGCTTCAATCCGACAAC | 203<br>204 | A fragment of the epsps locus for cloning and sequencing |

The same PCR reactions were done on five samples of genomic DNA obtained from untransformed maize inbred plantlets. After an initial denaturation at 95° C. for 5 minutes, each PCR amplification was carried out over 35 cycles using DNA Engine Tetrad2 Thermal Cycler (BioRad Laboratories, Hercules, CA) at 94° C. for 30 sec denaturation, 68° C. for 30 sec annealing, and 72° C. for 1 min extension. PCR products F-E2, F-T and H-T were separated in 1% agarose gel at 100 Volts for 45 minutes, with 100 bp DNA Ladder (N0467S, NewEngland Biolabs). For sequencing, the F-F3 PCR amplified fragments from selected calli were cloned into pCR 2.1-TOPO vectors using the TOPO TA Cloning Kit (Invitrogen Corp, Carlsbad, CA). DNA sequencing was done with BigDye Terminator chemistry on ABI 3700 capillary sequencing machines (Applied Biosystems, Foster City, CA). Each sample contained about 0.5 ug Topo plasmid DNA and 6.4 pmole primer E3-EPex3 Rev (ACCAAGCTGCTTCAATCCGACAAC, SEQ ID NO: 204). Sequences were analyzed using the Sequencer program.

A sample of thirty one callus events selected on media containing bialophos (the moPAT selectable marker gene was part of the guide RNA-moCas9 expression vector) were screened for the presence of the TIPS point mutations. Twenty four events contained the TIPS point mutations integrated into genomic DNA (FIG. 16, the F-E2 treatment). Among them, six events showed the PCR amplification product of the chromosomal EPSPS gene with TIPS mutations (FIG. 16, the H-T treatment). The pair of PCR primers (one that can hybridize to the genomic epsps sequence not present in the EPSPS polynucleotide modification template and the other one binding to the edited EPSPS sequence present in the EPSPS polynucleotide modification template) distinguished the EPSPS-TIPS editing products from the wild-type epsps alleles or random insertions of the TIPS mutations. If one EPSPS allele was edited to contain the TIPS substitutions, it should be detected as a DNA fragment originating from the genomic epsps locus, regardless whether the TIPS substitutions were selected for during the PCR amplification process. The TIPS primer was replaced with the wild-type EPSPS primer (Table 15, the F-E3 pair of primers) and the PCR amplification products were cloned into the TOPO cloning vectors and sequenced. The sequencing data represented a random sample of the genomic epsps locus sequences in one of the selected events (FIG. 17 A, B, callus A12 3360.92). FIG. 17 A, B shows that the method disclosed herein resulted in the successful nucleotide editing of three nucleotides (FIG. 17 A, B bold) responsible for the TIPS mutations without altering any of the other epsps nucleotides, while the moCas9 target sequence (the site of guide RNA binding underlined in FIG. 17 A, B) was not mutagenized.

Also, the other EPSPS allele was not edited indicating that only one EPSPS allele was edited in this particular event (FIG. 17 A, B, lower section).

This data further shows that the present disclosure of the use of the guide RNA/Cas system for the gene editing demonstrates the ability to recover gene editing events at a high efficiency of 1 out of fewer than 10 selected events.

Example 17

The Guide RNA/Cas Endonuclease System Delivers Double-Strand Breaks to the Maize Epsps Locus Resulting in Maize Plants Containing an EPSPS-TIPS Edited Gene The EPSPS gene edited events were produced and selected as described in the Example 16. In short, the EPSPS polynucleotide modification template was co-delivered using particle gun bombardment as a plasmid (see template vector 1, FIG. 15) together with the guide RNA expression cassette and a maize optimized Cas9 endonuclease expression vector which contained the maize optimized Cas9 endonuclease expression cassette described in FIG. 1A (Example 1, SEQ ID NO:5) and also contained a moPAT selectable marker gene.

After six weeks of selection at 28° C., a small amount of selected tissue was transferred onto the MS regeneration medium and incubated for three weeks in the dark at 28° C. After the three week incubation visible shoots were transferred to plates containing the MS-1 medium and incubated at 26° C. in the light for 1-2 weeks until they were ready to be sent to a greenhouse and transferred into soil flats. The Ms-1 medium contained: 4.3 g/L MS salts (Gibco 11117), 5.0 ml/L MS Vitamins Stock Solution (Sigma M3900), 100 mg/L myo-inositol, 40.0 g/L sucrose, and 6.0 g/L Bacto-Agar at pH 5.6.

Using the procedures described above, 390 TO maize plants were produced originating from 3282 embryos, resulting in an overall transformation efficiency of 12%, further indicating that the guide RNA/Cas system used herein results in low or no toxicity (Table 16).

TABLE 16

Transformation efficiency of the EPSPS editing.

| Treatment | # Embryos | # Calli selected | Selection efficiency | T0 plants to GH | Overall Efficiency |
|---|---|---|---|---|---|
| Particle bombardment | 3282 | 489 | 15% | 390 | 12% |

DNA was extracted from each TO plantlet 7-10 days after transfer to the greenhouse and PCR procedures were conducted as described in the Example 16 to screen the TO plants for mutations at the epsps locus.

Seventy two percent of analyzed TO plants (270/375, Table 17) contained mutagenized EPSPS alleles as determined by the end-point PCR procedure described in the Example 16. Most of the mutations (230/375 or 89%) were produced as a result of error-prone non-homologous end joining (NHEJ) while forty T0 plants (40/375 or 11%) contained the TIPS edited EPSPS alleles indicating the involvement of a templated double-strand break repair mechanism (Table 17).

TABLE 17

Mutations at the epsps locus.

| Transformation | TO Plants Analyzed | Mutations at the epsps locus | Mutation rate | TIPS editing | Gene Editing Rate (TIPS) |
|---|---|---|---|---|---|
| Particle bombardment | 375 | 270 | 72% | 40 | 11% |

A pair of primers (Table 15, the F-E3 pair of primers) was used to amplify a native, endogenous fragment of the epsps locus containing the moCas6 target sequence and the EPSPS editing site from the genomic DNA of selected TO plants. The PCR amplification products were cloned into the TOPO cloning vectors and sequenced as described in Example 16. The sequencing data represent a random sample of the genomic epsps locus sequences from a particular TO plant (Table 18) and indicate the genotype of the selected TO plants. The list of the EPSPS-TIPS allele-containing TO plants transferred to the pots is presented in Table 18 (a selected set of TO plants from the original 40 TIPS-containing events).

TABLE 18

The epsps locus genotypes observed in T0 plants. TIPS refers to a clone comprising the TIPS edited EPSPS sequence. NHEJ refers to the presence of a NHEJ mutation and WT refers to the presence of a wild-type EPSPS sequence amplified from the native epsps locus.

| Event (T0 plant) | Observed Sequences found at the epsps locus |
|---|---|
| E1 | 16 TIPS, 13 NHEJ |
| E2 | 28 TIPS, 0 NHEJ |
| E3 | 2 TIPS, 20 WT |
| E4 | 1 TIPS, 28 NHEJ |
| E5 | 2 TIPS, 2 NHEJ, 9 WT |
| E6 | 10 TIPS, 17 NHEJ |
| E7 | 12 TIPS, 17 NHEJ |
| E8 | 11 TIPS, 15 NHEJ |
| E9 | 17 TIPS, 10 NHEJ |

As presented in Table 18, the selected plants of E1 and E3 to E9 contained the EPSPS-TIPS edited version of the EPSPS gene either accompanied by a wild-type EPSPS allele (WT) or a NHEJ mutagenized EPSPS allele (NHEJ).

The numbers before TIPS, WT, NHEJ in Table18 indicate the frequency at which a particular version of the EPSPS allele was identified. If all clones contained the TIPS-edited EPSPS sequence, the analyzed plant was likely to be homozygous for the EPSPS-TIPS allele (see for example E2). If only about 50% of clones contained a TIPS-edited EPSPS sequence, the analyzed plant was likely to be hemizygous for the EPSPS-TIPS allele (see for example E1). Other plants, such as E3 or E4, were likely to be chimeric for TIPS. In one event, E2, the T0 plant contained only TIPS-edited sequence at the epsps locus indicating that the guide RNA/Cas endonuclease system disclosed herein resulted in the successful nucleotide editing of three nucleotides (FIG. 17 A, B bold) responsible for the two EPSPS-TIPS alleles at the epsps locus in maize plants.

A qPCR analysis was performed on the selected T0 plants to estimate the copy number of the wild-type EPSPS genes and the moCas9 endonuclease sequences. Multiplex qPCR amplifications of the maize EPSPS gene and the ADH housekeeping gene were carried out on the DNA samples from T0 plants. The primers and probes used in the PCR reaction are shown in Table 19.

TABLE 19

Primers used in qPCR analysis of T0 plants.

| Primer/probe | Primary PCR Primer Sequence | SEQ ID NO: |
|---|---|---|
| primer qADH F | 5'-CAAGTCGCGGTTTTCAATCA-3 | SEQ ID NO: 217 |
| Primer qADH R | 5'-TGAAGGTGGAAGTCCCAACAA-3' | SEQ ID NO: 218 |
| probe ADH-VIC | VIC-TGGGAAGCCTATCTACCAC | SEQ ID NO: 219 |
| Probe wtEPSPS | 6FAM-CGGCCATTGACAGCA-MGB-NFQ | SEQ ID NO: 220 |
| Forward primer qEPSPS F | 5'-TCTTGGGGAATGCTGGAACT-3' | ,SEQ ID NO: 221 |
| reverse primer qEPSPSR | 5'-CACCAGCAGCAGTAACAGCTG-3' | SEQ ID NO: 222 |
| FAM-wtEPSPS R probe | 6FAM-TGCTGTCAATGGCCGCA | SEQ ID NO: 223 |
| forward primer qEPSPS F | 5'-TCTTGGGGAATGCTGGAACT-3' | SEQ ID NO: 224 |
| reverse primer q wtEPSPS RA | 5'-CCACCAGCAGCAGTAACAGC-3 | SEQ ID NO: 225) |

All analyses were conducted using the LightCycler 480 Real-Time PCR System (Roche Diagnostics). A threshold value for the wtEPSPS genotype was set at 1.76. Every sample showing less than 1.76 copies of EPSPS, with the end-point florescence measurements up to two times lower than the wild-type control, was categorized as the One Allele EPSPS genotype (hemizygous for the wild-type EPSPS allele).

A qPCR method was used to estimate the TIPS sequence copy number. The primers and probes used in the qPCR reaction are shown in Table 20.

TABLE 20

Primers used in qPCR analysis to estimate the TIPS sequence copy number.

| Primer/probe | Primary PCR Primer Sequence | SEQ ID NO: |
|---|---|---|
| forward primer q epTIPS F | 5'-GGAAGTGCAGCTCTTCTTGGG-3' | SEQ ID NO: 226 |

TABLE 20-continued

Primers used in qPCR analysis to estimate the TIPS sequence copy number.

| Primer/probe | Primary PCR Primer Sequence | SEQ ID NO: |
|---|---|---|
| reverse primer q epTIPS R | 5'-AGCTGCTGTCAATGACCGC-3' | SEQ ID NO: 227 |
| TIPS probe | 6FAM-AATGCTGGAATCGCA | SEQ ID NO: 228) |

A comparative Ct method with Delta Ct values normalized to the average Delta Ct from the bi-allelic TIPS genotypes provided a copy number estimation for the TIPS sequence detected in the analyzed plant samples.

TABLE 21 qPCR genotyping and copy number of selected T0 plants.

| Event name | TIPS EPSPS allele | Wild-type EPSPS allele # | TIPS copy # | moCas9 coding sequence |
|---|---|---|---|---|
| E1 | positive | Null | 5 | positive |
| E2 | positive | Null | 2 | positive |
| E7 | positive | Null | 6 | positive |
| E8 | positive | Null | 1 | positive |
| E9 | positive | Null | 3 | positive |

The qPCR genotyping indicated that no wild-type EPSPS alleles were detected in the selected T0 plants of Events E1, E2, E7, E8 and E9 (Table 21). Both, the TIPS template sequences and the moCas9 coding sequence were found in the selected T0 plants, presumably, as a result of random insertions associated with the transformation process (Table 21: for the TIPS template sequences E1, E7, and E9 T0 plants). Both genetic elements (the randomly inserted TIPS templates and the moCas9 expression cassette) can be segregated out by standard breeding procedures in the T1 progeny generation, if not linked to the edited EPSPS-TIPS gene.

T0 plants grew well in the greenhouse and were fertile. A sample of T0 plants was sprayed with a 1× dose of glyphosate (Roundup Powermax) at V3 growth stage using the spray booth setting of 20 gallons per acre. The 1× dose of glyphosate was prepared as follow: 2.55 ml Powermax in 300 ml water (active ingredient: glyphosate, N-(phosphonomethyl) glycine, in the form of its potassium salt at 48.7%). Seven days after glyphosate application, no leaf tissue damage was observed in some of the T0 plants. These plantlets were hemizygous for the EPSPS-TIPS alleles, while other plantlets were severely damaged. One plant showing no damage to the leaf tissue 14 days after herbicide application contained 21 EPSPS-TIPS alleles among 44 genomic clones of the epsps locus (cloned and sequenced as described in the Example 16).

These data indicate that a guide RNA/Cas system can be used to create a TIPS-edited EPSPS allele in maize. Maize plants homozygous at the epsps-tips locus (two EPSPS alleles edited) with no additional insertion of the TIPS template (plant E2) were obtained. Furthermore, some EPSPS-TIPS edited maize plants did show some level of tolerance against a 1× dose of glyphosate.

Example 18

Guide RNA/Cas Endonuclease Mediated DNA Cleavage in Maize Chromosomal Loci Enables Transgene Insertion in an Elite Maize Line To test whether a maize optimized guide RNA/Cas system can cleave an maize chromosomal locus and enable homologous recombination (HR) mediated pathways to site-specifically insert a transgene in an elite maize line, 4 loci were selected on the maize chromosome 1 located between 51.54 cM to 54.56 cM (FIG. 18). Two target sites for a Cas endonuclease were identified at each of the four loci and are referred to as MHP14Cas-1, MHP14Cas-3, TS8Cas-1, TS8Cas2, TS9Cas-2, TS9Cas-3, TS10Cas-1 and TS10Cas-3 (FIG. 19 A-D, Table 22, SEQ ID NOs:229-236).

TABLE 22

Maize genomic target sites targeted by a guide RNA/Cas endonuclease.

| Locus | Location | Target Site | Maize Genomic Target Site Sequence | PAM | SEQ ID NO: |
|---|---|---|---|---|---|
| MHP14 | Chr. 1: 51.54cM | MHP14Cas-1 | gttaaatctgacgtgaatctgtt | TGG | 229 |
|  |  | MHP14Cas-3 | acaaacattgaagcgacatag | TGG | 230 |
| TS8 | Chr. 1: 52.56cM | TS8Cas-1 | gtacgtaacgtgcagtac | TGG | 231 |
|  |  | TS8Cas-2 | gctcatcagtgatcagctgg | TGG | 232 |
| TS9 | Chr. 1: 53.56cM | TS9Cas-2 | ggctgtttgcggcctcg | AGG | 233 |
|  |  | TS9Cas-3 | gcctcgaggttgcacgcacgt | CGG | 234 |
| TS10 | Chr.1: 54.56cM | TS10Cas-1 | gcctcgccttcgctagttaa | GGG | 235 |
|  |  | TS10Cas-3 | gctcgtgttggagataca | GGG | 236 |

The maize optimized Gas endonuclease cassette (SEQ ID NO: D was as prepared as describe in Example 1. Long guide RNA expression cassettes comprising a variable targeting domain targeting one of the 8 genomic target sites, driven by a maize U6 polymerase III promoter, and terminated by a maize U6 polymerase III terminator were designed as described in Example 1 and 3 and listed in Table 23. A donor DNA (HR repair DNA) containing a selectable marker (a phosphomannose-isomerase (PMI) expression cassette) flanked by two homologous regions was constructed using standard molecular biology techniques (FIG. 20).

HR-mediated transgenic insertions were selected by placing the callus on mannose containing media. After selection, stable shoots on maturation plates were sampled, total genomic DNA extracted, and using the primer pairs shown in Table 24 (corresponding to SEQ ID NOs: 261-270), PCR amplification was carried out at both possible transgene genomic DNA junctions to identify putative HR-mediated transgenic insertions.

TABLE 24

Primer sequences used for integration event screening at each target site

| Locus | Target Site | Junction | Primer | SEQ ID NO: |
|---|---|---|---|---|
| UBIR | donor | 1 | CCATGTCTAACTGTTCATTTATATGATTCTCT | 261 |
| PSBF | donor | 2 | GCTCGTGTCCAAGCGTCACTTACGATTAGCT | 262 |
| MHP14 | MHP14Cas-1 | 14-1HR1f | CTCACATGAGGCTCTTCTTTGCTTGCT | 263 |
|  | MHP14Cas-3 | 14-1HR2r | AGGATCCTATTCCCCAATTTGTAGAT | 264 |
| CHR1-8 | TS8Cas-1 | 8HR1f | CAGTCCGTGGATTGAAGCCAT | 265 |
|  | TS8Cas-2 | 8HR2r | CTCTGTCTCCGAGACGTGCTTA | 266 |
| CHR1-9 | TS9Cas-2 | 9HR1f | GGAGCAAATGTTTTAGGTATGAAATG | 267 |
|  | TS9Cas-3 | 9HR2r | CGGATTCTAAAGATCATACGTAAATGAA | 268 |
| CHR1-10 | TS10Cas-1 | 10HR1f | TGGCTTGTCTATGCGCATCTC | 269 |
|  | TS10Cas-3 | 10HR2r | CCAGACCCAAACAGCAGGTT | 270 |

TABLE 23

List of guide RNA (gRNA) and Donor DNA expression cassettes

| Locus | Target Site | gRNA (SEQ ID NO:) | Donor DNA (SEQ ID NO:) |
|---|---|---|---|
| MHP14 | MHP14Cas-1 | 245 | 253 |
|  | MHP14Cas-3 | 246 | 254 |
| TS8 | TS8Cas-1 | 247 | 255 |
|  | TS8Cas-2 | 248 | 256 |
| TS9 | TS9Cas-2 | 249 | 257 |
|  | TS9Cas-3 | 250 | 258 |
| TS10 | TS10Cas-1 | 251 | 259 |
|  | TS10Cas-3 | 252 | 260 |

A vector containing the maize optimized Cas9 endonuclease of SEQ ID NO: 5, a vector containing one of eight long guide RNA expression cassettes of SEQ ID NOs: 245-252, and a vector containing one of eight donor DNAs of SEQ ID NOs: 253-260 were co-delivered to maize elite line immature embryos by particle-mediated delivery as described in Example 10. About 1000 embryos were bombarded for each target site. Since the donor DNA contained a selectable marker, PMI, successful delivery of the donor DNA allowed for callus growth on mannose media. Putative The same genomic primers were used for each of the two target sites at one locus. The resulting amplifications were sequenced to determine if these sites were mutated or contained a transgene insertion.

The "Event Recovery frequency" was calculated using the number of events recovered divided by the total number of embryos bombarded, and may indicate if an endonuclease has some toxic effect or not (Table 26). Hence, if 1000 embryos were bombarded and 240 were recovered, the Event Recovery frequency is 24%. Table 26 indicates that for all target sites analyzed the Event Recovery frequency ranged between 17 and 28%, indicating that the guide RNA/Cas system used herein results in low or no toxicity. Cas endonuclease activity was measured in-planta by determining the "Target Site Mutation frequency" (Table 26) is defined as: (number of events with target site modification/total number recovered events)*100%. Hence, if 240 events were recovered and 180 events showed a mutation, the Target Site Mutation frequency is 75%. The target site mutation frequency was measured using target site allele copy number as described in Example 9 of U.S. application Ser. No. 13/886,317, filed on May 3, 2013. The primers and probes for obtaining the target site copy number using qPCR at each site were as listed in Table 25 (SEQ ID NO: 271-294).

TABLE 25

Primer and probe sequences used to assess DNA cleavage at 8 maize genomic target sites

| Target Site Designation | Probe primers | Primer sequence | SEQ ID NO: |
|---|---|---|---|
| MHP14Cas-1 | probe | CAGATTCACGTCAGATTT | 271 |
| | forward | CATAGTGGTGTATGAAAGGAAGCACTT | 272 |
| | reverse | CATTTTGGATTGTAATATGTGTACCTCATA | 273 |
| MHP14Cas-3 | probe | CACCACTATGTCGCTTC | 274 |
| | forward | CGGATGCACGAAAATTGTAGGA | 275 |
| | reverse | CTGACGTGAATCTGTTTGGAATTG | 276 |
| TS8Cas-1 | probe | TACGTAACGTGCAGTACT | 277 |
| | forward | ACGGACGGACCATACGTTATG | 278 |
| | reverse | TCAGCTGGTGGAGTATATTAGTTCGT | 279 |
| TS8Cas-2 | probe | CCAGCTGATCACTGATGA | 280 |
| | forward | ACGGACGGACCATACGTTATG | 281 |
| | reverse | CGCACATGTTATAAATTACAATGCAT | 282 |
| TS9Cas-2 | probe | CTGTTTGCGGCCTC | 283 |
| | forward | CTGCGGAGCTGCTGGCGAT | 284 |
| | reverse | CTTGCTGGCTTCGTCTGTCA | 285 |
| TS9Cas-3 | probe | CCGACGTGCGTGCAA | 286 |
| | forward | CTGCGGAGCTGCTGGCGAT | 287 |
| | reverse | CTTGCTGGCTTCGTCTGTCA | 288 |
| TS10Cas-1 | probe | TCGCCTTCGCTAGTTAA | 289 |
| | forward | AAGACCTGGCCGGTTTTCCA | 290 |
| | reverse | TAGCGGCCATTGCCATCA | 291 |
| TS10Cas-3 | probe | CTGTATCTCCAACACGAGC | 292 |
| | forward | AAGACCTGGCCGGTTTTCCA | 293 |
| | reverse | TAGCGGCCATTGCCATCA | 294 |

As shown in Table 26, all 8 guide RNA/Cas9 systems were very efficient in cleaving their target DNA and inducing mutations (by non-homologous end joining (NHEJ) as is evidenced by a mutation frequency ranging from 33-90%.

All events were also screened for the presence of an inserted transgene. The insertion event screening for each target site is illustrated in FIG. 21. The primers used for insertion PCR analysis at each site are listed in Table 24. FIG. 22 shows one example of an insertion event screening PCR result. The frequency of transgene insertion was determined by calculating the "Insertion frequency" which is defined as: (number of events with target site insertion/total number recovered events)*100%. Hence, if 240 events were recovered and 21 events showed a transgene insertion, the Insertion frequency was 9%.

TABLE 26

Activity of the guide RNA/Cas 9 system at 8 target sites as determined by target site mutation frequency and transgene insertion frequency at the desired target site in maize plant tissue

| Target Site | Event Recovery (%) | Target Site Mutation (%) | Insertion frequency (%) |
|---|---|---|---|
| TS10Cas-1 | 24% | 75% | 9% (7*) |
| TS10Cas-3 | 22% | 83% | 16% (20*) |
| TS8Cas-1 | 17% | 90% | 14% (9*) |
| TS8Cas-2 | 27% | 84% | 8% (10*) |
| MHP14Cas-1 | 17% | 33% | 2% (2*) |
| MHP14Cas-3 | 28% | 68% | 4% (1*) |
| TS9Cas-2 | 23% | 62% | 8%** |
| TS9Cas-3 | 28% | 84% | 8%** |

*Number of events with HR1 and HR2 both junctions positive
**only HR2 junction available Sequence-confirmed-PCR amplifications indicated a site-specific transgene insertion for each of the 8 target sites as shown in Table 26 (column Insertion frequency). A transgene cassette was inserted at all 8 target sites with high efficiency (2-16%). The number of events containing amplifications across both transgene genomic DNA junctions, indicating near perfect site-specific transgene insertion, are show in brackets in Table 26.

Taken together, these data demonstrates that maize chromosomal loci cleaved with the maize optimized guide RNA/Cas system described herein can be used to insert transgenes at high frequencies in maize elite inbred line.

Example 19

Delivery of the Guide RNA/Cas9 Endonuclease System DNA to Soybean by Stable Transformation A soybean U6 small nuclear RNA promoter (GM-U6-9.1; SEQ ID NO: 295) was identified in a similar manner as the soybean promoter GM-U6-13.1 (SEQ ID NO:120) described in Example 12. The GM-U6-9.1 promoter was used to express guide RNA to direct Cas9 nuclease to designated genomic target site.

A soybean codon optimized Cas9 endonuclease expression cassette (such as for example EF1A2:CAS9, SEQ ID NO: 296) and a guide RNA expression cassette (such as for example U6-9.1:DD20CR1; SEQ ID NO: 297) were linked (such as U6-9.1: DD20CR1+EF1A2:CAS9; SEQ ID NO: 298, FIG. 23A) and integrated into a DNA plasmid that was co-delivered with another plasmid comprising a donor DNA (repair DNA) cassette (such as DD20HR1-SAMS:HPT-DD20HR2; SEQ ID NO: 299) to young soybean somatic embryos in the form of embryogenic suspension cultures by particle gun bombardment (FIGS. 23A and 23B). Other guide RNA/Cas9 DNA constructs targeting various soybean genomic sites and donor DNA constructs for site-specific transgene integration through homologous recombination were similarly configured and are listed in Table 27. The four gRNA/Cas9 constructs differed only in the 20 bp guide RNA targeting domain (variable targeting domain) targeting the soybean genomic target sites DD20CR1 (SEQ ID NO: 125), DD20CR2 (SEQ ID NO: 126), DD43CR1 (SEQ ID NO: 127), or DD43CR2 (SEQ ID NO: 128). The two donor DNA constructs differed only in the homologous regions such as DD20HR1 and DD20HR (FIG. 23B), or DD43HR1 and DD43HR2. These guide RNA/Cas9 DNA constructs and donor DNAs were co-delivered to an elite (93B86) or a non-elite (Jack) soybean genome by the stable transformation procedure described below.

TABLE 27

Guide RNA/Cas9 Mediated Soybean Stable Transformation.

| Experiment | Guide RNA/Cas9 | Donor DNA | SEQ ID NOs: |
|---|---|---|---|
| U6-9.1DD20CR1 | U6-9.1:DD20CR1 + EF1A2:CAS9 | DD20HR1-SAMS: HPT-DD20HR2 | 298, 299 |
| U6-9.1DD20CR2 | U6-9.1:DD20CR2 + EF1A2:CAS9 | DD20HR1-SAMS: HPT-DD20HR2 | 300, 299 |
| U6-9.1DD43CR1 | U6-9.1:DD43CR1 + EF1A2:CAS9 | DD43HR1-SAMS: HPT-DD43HR2 | 301, 302 |
| U6-9.1DD43CR2 | U6-9.1:DD43CR2 + EF1A2:CAS9 | DD43HR1-SAMS: HPT-DD43HR2 | 303, 302 |

Soybean somatic embryogenic suspension cultures were induced from a DuPont Pioneer proprietary elite cultivar 93B86 as follows. Cotyledons (~3 mm in length) were dissected from surface sterilized, immature seeds and were cultured for 6-10 weeks in the light at 26° C. on a Murashige and Skoog (MS) media containing 0.7% agar and supplemented with 10 mg/ml 2,4-D (2,4-Dichlorophenoxyacetic acid). Globular stage somatic embryos, which produced secondary embryos, were then excised and placed into flasks containing liquid MS medium supplemented with 2,4-D (10 mg/ml) and cultured in light on a rotary shaker. After repeated selection for clusters of somatic embryos that multiplied as early, globular staged embryos, the soybean embryogenic suspension cultures were maintained in 35 ml liquid media on a rotary shaker, 150 rpm, at 26° C. with fluorescent lights on a 16:8 hour day/night schedule. Cultures were subcultured every two weeks by inoculating approximately 35 mg of tissue into 35 ml of the same fresh liquid MS medium.

Soybean embryogenic suspension cultures were then transformed by the method of particle gun bombardment using a DuPont Biolistic™ PDS1000/HE instrument (Bio-Rad Laboratories, Hercules, CA). To 50 µl of a 60 mg/ml 1.0 mm gold particle suspension were added in order: 30 µl of equal amount (30 ng/µl) plasmid DNA comprising, for example, U6-9.1:DD20CR1+EF1A2:CAS9 (SEQ ID NO:298) and plasmid DNA comprising, for example, (DD20HR1-SAMS:HPT-DD20HR2, SEQ ID NO: 299) (Experiment U6-9.1 DD20CR1 listed in Table 27) 20 µl of 0.1 M spermidine, and 25 µl of 5 M CaCl$_2$. The particle preparation was then agitated for 3 minutes, spun in a centrifuge for 10 seconds and the supernatant removed. The DNA-coated particles were then washed once in 400 µl 100% ethanol and resuspended in 45 µl of 100% ethanol. The DNA/particle suspension was sonicated three times for one second each. Then 5 µl of the DNA-coated gold particles was loaded on each macro carrier disk.

Approximately 300-400 mg of a two-week-old suspension culture was placed in an empty 60×15 mm Petri dish and the residual liquid removed from the tissue with a pipette. For each transformation experiment, approximately 5 to 10 plates of tissue were bombarded. Membrane rupture pressure was set at 1100 psi and the chamber was evacuated to a vacuum of 28 inches mercury. The tissue was placed approximately 3.5 inches away from the retaining screen and bombarded once. Following bombardment, the tissue was divided in half and placed back into liquid media and cultured as described above.

Five to seven days post bombardment, the liquid media was exchanged with fresh media containing 30 mg/ml hygromycin as selection agent. This selective media was refreshed weekly. Seven to eight weeks post bombardment, green, transformed tissue was observed growing from untransformed, necrotic embryogenic clusters. Isolated green tissue was removed and inoculated into individual flasks to generate new, clonally propagated, transformed embryogenic suspension cultures. Each clonally propagated culture was treated as an independent transformation event and subcultured in the same liquid MS media supplemented with 2,4-D (10 mg/ml) and 30 ng/ml hygromycin selection agent to increase mass. The embryogenic suspension cultures were then transferred to agar solid MS media plates without 2,4-D supplement to allow somatic embryos to develop. A sample of each event was collected at this stage for quantitative PCR analysis.

Cotyledon stage somatic embryos were dried-down (by transferring them into an empty small Petri dish that was seated on top of a 10 cm Petri dish containing some agar gel to allow slow dry down) to mimic the last stages of soybean seed development. Dried-down embryos were placed on germination solid media and transgenic soybean plantlets were regenerated. The transgenic plants were then transferred to soil and maintained in growth chambers for seed production. Transgenic events were sampled at somatic embryo stage or T0 leaf stage for molecular analysis.

Similar transformation experiments (U6-9.1 DD20CR2, U6-9.1 DD43CR1, U6-9.1 DD43CR2) with the components listed in Table 27 and using the elite cultivar 93B86 were performed as described above.

Two transformation experiments, U6-9.1 DD20CR1 and U6-9.1 DD43CR1 listed in Table 27, were also performed in a non-elite soybean cultivar "Jack" to test the gRNA/Cas9 system performance in different soybean genotypes.

Example 20

Detection of Site-Specific NHEJ Mediated by the Guide RNA/Cas9 System in Stably Transformed Soybean Genomic DNA was extracted from somatic embryo samples and analyzed by quantitative PCR using a 7500 real time PCR system (Applied Biosystems, Foster City, CA)

with target site-specific primers and FAM-labeled fluorescence probe to check copy number changes of the target site DD20 or DD43 (FIG. 24 A-C). The qPCR analysis was done in duplex reactions with a heat shock protein (HSP) gene as the endogenous controls and a wild type 93B86 genomic DNA sample that contains one copy of the target site with 2 alleles, as the single copy calibrator. The HSP endogenous control qPCR employed primer probe set HSP-F/HSP-T/HSP-R. The DD20-CR1 (SEQ ID NO:306) and DD20-CR2 (SEQ ID NO:307) specific qPCR employed primer probe set DD20-F (SEQ ID NO:308)/DD20-T (SEQ ID NO:309)/DD20-R(SEQ ID NO:310). The DD43-CR1 (SEQ ID NO:311) specific qPCR employed primer probe set DD43-F (SEQ ID NO:313)/DD43-T (SEQ ID NO:315)/DD43-R (SEQ ID NO:316) while the DD43-CR2 (SEQ ID NO:312) specific qPCR employed primer probe set DD43-F2 (SEQ ID NO:314)/DD43-T/DD43-R. The guide RNA/Cas9 DNA (SEQ ID NOs: 298, 300, 301, and 303) specific qPCR employed primer probe set Cas9-F (SEQ ID NO:317/Cas9-T (SEQ ID NO:318)/Cas-9-R (SEQ ID NO:319). The donor DNA (SEQ ID NOS: 299, and 302) specific qPCR employed primer probe set Sams-76F (SEQ ID NO:320)/FRT1I63-T (SEQ ID NO:321)/FRT1I-41F (SEQ ID NO:322). The endogenous control probe HSP-T was labeled with VIC and the gene-specific probes DD20-T, DD43-T, Cas9-T, and FRT1I63-T were labeled with FAM for the simultaneous detection of both fluorescent probes (Applied Biosystems). PCR reaction data were captured and analyzed using the sequence detection software provided with the 7500 real time PCR system and the gene copy numbers were calculated using the relative quantification methodology (Applied Biosystems).

Since the wild type 93B86 genomic DNA with two alleles of the target site was used as the single copy calibrator, events without any change of the target site would be detected as one copy herein termed Wt-Homo (qPCR value>=0.7), events with one allele changed, which is no longer detectable by the target site-specific qPCR, would be detected as half copy herein termed NHEJ-Hemi (qPCR value between 0.1 and 0.7), while events with both alleles changed would be detected as null herein termed NHEJ-Null (qPCR value=<0.1). The wide range of the qPCR values suggested that most of the events contained mixed mutant and wild type sequences of the target site. High percentage of NHEJ-Hemi (ranging from 10.1 to 33.5%, Table 28) and NHEJ-Null (ranging from 32.3 to 46.4%, Table 21) were detected in all four experiments with combined NHEJ average frequencies of more than 60% (Table 28).

TABLE 28

Target Site Mutations and Site Specific Gene Integration Induced by the Guide RNA/Cas9 system in elite soybean germplasm.

| Project | Total event | Wt-Homo (%) | NHEJ-Hemi (%) | NHEJ-Null (%) | Insertion Frequency (%) |
|---|---|---|---|---|---|
| U6-9.1DD20CR1 | 239 | 85 (35.6%) | 77 (32.2%) | 77 (32.2%) | 11 (4.6%) |
| U6-9.1DD20CR2 | 79 | 43 (54.4%) | 8 (10.1%) | 28 (35.4%) | NA |
| U6-9.1DD43CR1 | 263 | 53 (20.2%) | 88 (33.5%) | 122 (46.4%) | 10 (3.8%) |

Numbers indicate no. of events (numbers in parentheses are %).
NA = not analyzed.

TABLE 29

Target Site Mutations and Site Specific Gene Integration Induced by the Guide RNA/Cas9 system in non-elite soybean germplasm.

| Project | Total event | Wt-Homo (%) | NHEJ-Hemi (%) | NHEJ-Null (%) | Insertion frequency (%) |
|---|---|---|---|---|---|
| U6-9.1DD20CR1-Jack | 149 | 99 (66.4%) | 34 (22.8%) | 16 (10.7%) | 0 (0%) |
| U6-9.1DD43CR1-Jack | 141 | 84 (59.6%) | 27 (19.1%) | 30 (21.3%) | 1 (0.7%) |

Numbers indicate no. of events (numbers in parentheses are % of the total analyzed events).

Both NHEJ-Hemi and NHEJ-Null were detected in the two experiments U6-9.1DD20CR1-Jack and U6-9.1DD43CR1-Jack repeated in "Jack" genotype though at lower frequencies (Table 29). The differences between NHEJ frequencies were likely caused by variations between transformation experiments.

The target region of NHEJ-Null events were amplified by regular PCR from the same genomic DNA samples using DD20-LB (SEQ ID NO: 323) and DD20-RB (SEQ ID NO: 326) primers specific respectively to DD20-HR1 and DD20-HR2 for DD20 target site specific HR1-HR2 PCR amplicon (FIG. 25 A-C; SEQ ID NO: 329), or DD43-LB (SEQ ID NO: 327) and DD43-RB (SEQ ID NO: 328) primers specific respectively to DD43-HR1 and DD43-HR2 for DD43 target site specific HR1-HR2 PCR amplicon (SEQ ID NO: 332). The PCR bands were cloned into pCR2.1 vector using a TOPO-TA cloning kit (Invitrogen) and multiple clones were sequenced to check for target site sequence changes as the results of NHEJ. Various small deletions at the Cas9 cleavage site, 3 bp upstream of the PAM, were revealed at all four tested target sites (FIG. 26 A-C). Small insertions were also detected in some sequences. Different mutated sequences were identified from some of the same events indicating the chimeric nature of these events. Some of the same mutated sequences were also identified from different events suggesting that the same mutations could have happened independently or some of the events could be clonal events. These sequence analysis confirmed the occurrence of NHEJ mediated by the guide RNA/Cas9 system at the specific Cas9 target sites.

Example 21

Identification of Site-Specific Gene Integration Via Homologous Recombination Mediated by the Guide RNA/Cas9 System in Stably Transformed Soybean Site-specific gene integration via guide RNA/Cas9 system mediated DNA homologous recombination was determined by border-specific PCR analysis. The 5' end borders of DD20CR1 and DD20CR2 events were amplified as a 1204 bp DD20 HR1-SAMS PCR amplicon (SEQ ID NO: 330) by PCR with primers DD20-LB (SEQ ID NO: 323) and Sams-A1 (SEQ ID NO: 324) while the 3' borders of the same events were amplified as a 1459 bp DD20 NOS-HR2 PCR amplicon (SEQ ID NO: 331) with primers QC498A-S1 and DD20-RB (FIG. 25 A-C). Any events with both the 5' border and 3' border-specific bands amplified are considered as site-specific integration events through homologous recombination containing the transgene from the donor DNA fragment DD20HR1-SAMS:HPT-DD20HR2 or its circular form (FIG. 23 A, B). The 5' end borders of DD43CR1 and DD43CR2 events were amplified as a 1202 bp DD43 HR1-SAMS PCR amplicon (SEQ ID NO: 333) by PCR with primers DD43-LB and Sams-A1 while the 3' borders of the same events were amplified as a 1454 bp DD43 NOS-HR2 PCR amplicon (SEQ ID NO: 334) with primers QC498A-S1 (SEQ ID NO: 325) and DD43-RB (SEQ ID NO: 328). Any events with both the 5' border and 3' border-specific bands amplified are considered as site-specific integration events through homologous recombination containing the transgene from repair DNA fragment DD43HR1-SAMS:HPT-DD43HR2 or its circular form. Some of the border-specific PCR fragments were sequenced and were all confirmed to be recombined sequences as expected from homologous recombination. On average, gene integration through the guide RNA/Cas9 mediated homologous recombination occurred at approximately 4% of the total transgenic events (Insertion frequency, Table 28 and Table 29). One homologous recombination event was identified from experiment U6-9.1 DD43CR1-Jack repeated in "Jack" genotype (Table 29).

Example 22

The crRNA/tracrRNA/Cas Endonuclease System Cleaves Chromosomal DNA in Maize and Introduces Mutations by Imperfect Non-Homologous End-Joining To test whether the maize optimized crRNA/tracrRNA/Cas endonuclease system described in Example 1 could recognize, cleave, and mutate maize chromosomal DNA through imprecise non-homologous end-joining (NHEJ) repair pathways, three different genomic target sequences were targeted for cleavage (see Table 30) and examined by deep sequencing for the presence of NHEJ mutations.

TABLE 30

Maize genomic target sequences targeted by a crRNA/tracrRNA/Cas endonuclease system.

| Locus | Location | Cas RNA System Used | Target Site Designation | Maize Genomic Target Site Sequence | PAM Sequence | SEQ ID NO: |
|---|---|---|---|---|---|---|
| LIG | Chr. 2: 28.45cM | crRNA/ tracrRNA | LIGCas-1 | GTACCGTACGTGCCCCGGCGG | AGG | 16 |
|  |  | crRNA/ tracrRNA | LIGCas-2 | GGAATTGTACCGTACGTGCCC | CGG | 17 |
|  |  | crRNA/ tracrRNA | LIGCas-3 | GCGTACGCGTACGTGTG | AGG | 18 |

LIG = Liguleless 1 Gene Promoter

The maize optimized Cas9 endonuclease expression cassette, crRNA expression cassettes containing the specific maize variable targeting domains (SEQ ID NOs: 445-447) complementary to the antisense strand of the maize genomic target sequences listed in Table 30 and tracrRNA expression cassette (SEQ ID NO: 448) were co-delivered to 60-90 Hi-II immature maize embryos by particle-mediated delivery (see Example 5) in the presence of BBM and WUS2 genes (see Example 6). Hi-II maize embryos transformed with the Cas9 and long guide RNA expression cassettes targeting the LIGCas-3 genomic target site (SEQ ID NO: 18) for cleavage served as a positive control and embryos transformed with only the Cas9 expression cassette served as a negative control. After 7 days, the 20-30 most uniformly transformed embryos from each treatment were pooled and total genomic DNA was extracted. The region surrounding the intended target site was PCR amplified with Phusion® High Fidelity PCR Master Mix (New England Biolabs, M0531 L) adding on the sequences necessary for amplicon-specific barcodes and Illumnia sequencing using "tailed" primers through two rounds of PCR. The primers used in the primary PCR reaction are shown in Table 31 and the primers used in the secondary P R reaction were

```
                                    (forward, SEQ ID NO: 53)
AATGATACGGCGACCACCGAGATCTACACTCTTTCCCTACACG
and (reverse, SEQ ID NO: 54)
CAAGCAGAAGACGGCATA.
```

TABLE 31

PCR primer sequences

| Target Site | Cas RNA System Used | Primer Orientation | Primary PCR Primer Sequence | SEQ ID NO: |
|---|---|---|---|---|
| LIGCas-1 | crRNA/tracrRNA | Forward | CTACACTCTTTCCCTACACGACGCTCTTCC GATCTTCCTCTGTAACGATTTACGCACCTG CTG | 36 |
| LIGCas-1 | crRNA/tracrRNA | Reverse | CAAGCAGAAGACGGCATACGAGCTCTTCC GATCTGCAAATGAGTAGCAGCGCACGTAT | 35 |
| LIGCas-2 | crRNA/tracrRNA | Forward | CTACACTCTTTCCCTACACGACGCTCTTCC GATCTGAAGCTGTAACGATTTACGCACCTG CTG | 449 |
| LIGCas-2 | crRNA/tracrRNA | Reverse | CAAGCAGAAGACGGCATACGAGCTCTTCC GATCTGCAAATGAGTAGCAGCGCACGTAT | 35 |
| LIGCas-3 | crRNA/tracrRNA | Forward | CTACACTCTTTCCCTACACGACGCTCTTCC GATCTAAGGCGCAAATGAGTAGCAGCGCAC | 37 |
| LIGCas-3 | crRNA/tracrRNA | Reverse | CAAGCAGAAGACGGCATACGAGCTCTTCC GATCTCACCTGCTGGGAATTGTACCGTA | 38 |
| LIGCas-3 | Long guide RNA | Forward | CTACACTCTTTCCCTACACGACGCTCTTCC GATCTTTCCCGCAAATGAGTAGCAGCGCAC | 450 |
| LIGCas-3 | Long guide RNA | Reverse | CAAGCAGAAGACGGCATACGAGCTCTTCC GATCTCACCTGCTGGGAATTGTACCGTA | 38 |

The resulting PCR amplifications were purified with a Qiagen PCR purification spin column, concentration measured with a Hoechst dye-based fluorometric assay, combined in an equimolar ratio, and single read 100 nucleotide-length deep sequencing was performed on Illumina's MiSeq Personal Sequencer with a 30-40% (v/v) spike of PhiX control v3 (Illumina, FC-110-3001) to off-set sequence bias. Only those reads with a ≥1 nucleotide indel arising within the 10 nucleotide window centered over the expected site of cleavage and not found in a similar level in the negative control were classified as NHEJ mutations. NHEJ mutant reads with the same mutation were counted and collapsed into a single read and the top 10 most prevalent mutations were visually confirmed as arising within the expected site of cleavage. The total numbers of visually confirmed NHEJ mutations were then used to calculate the % mutant reads based on the total number of reads of an appropriate length containing a perfect match to the barcode and forward primer.

The frequency of NHEJ mutations recovered by deep sequencing for the crRNA/tracrRNA/Cas endonuclease system targeting the three LIGCas targets (SEQ ID NOS: 16, 17, 18) compared to the long guide RNA/Cas endonuclease system targeting the same locus is shown in Table 32.

TABLE 32

Percent (%) mutant reads at maize Liguleless 1 target locus produced by crRNA/tracrRNA/Cas endonuclease system compared to the long guide RNA/Cas endonuclease system

| System | Total Number of Reads | Number of Mutant Reads | % Mutant Reads |
|---|---|---|---|
| Cas9 Only Control | 1,744,427 | 0 | 0.00% |
| LIGCas-3 long guide RNA | 1,596,955 | 35,300 | 2.21% |

TABLE 32-continued

Percent (%) mutant reads at maize Liguleless 1 target locus produced by crRNA/tracrRNA/Cas endonuclease system compared to the long guide RNA/Cas endonuclease system

| System | Total Number of Reads | Number of Mutant Reads | % Mutant Reads |
|---|---|---|---|
| LIGCas-1 crRNA/tracrRNA | 1,803,163 | 4,331 | 0.24% |
| LIGCas-2 crRNA/tracrRNA | 1,648,743 | 3,290 | 0.20% |
| LIGCas-3 crRNA/tracrRNA | 1,681,130 | 2,409 | 0.14% |

The ten most prevalent types of NHEJ mutations recovered based on the crRNA/tracrRNA/Cas endonuclease system are shown in FIG. 27A (for LIGCas-1 target site, corresponding to SEQ ID NOs:415-424), FIG. 27B (for LIGCas-2 target site corresponding to SEQ ID NOs: 425-434) and FIG. 27C (for LIGCas-3 target site corresponding to SEQ ID NOs:435-444). Approximately, 9-16 fold lower frequencies of NHEJ mutations were observed when using a crRNA/tracrRNA/Cas endonuclease system to introduce a double strand break at a maize genomic target site, relative to the long guide RNA/Cas endonuclease system control.

Taken together, our data indicate that the maize optimized crRNA/tracrRNA/Cas endonuclease system described herein cleaves maize chromosomal DNA and generates imperfect NHEJ mutations.

Example 23

Modifying the ARGOS8 Gene to Improve Drought Tolerance and Nitrogen Use Efficiency in Maize Plants ARGOS is a negative regulator for ethylene responses in plants (WO 2013/066805 A1, published 10 May 2013).

ARGOS proteins target the ethylene signal transduction pathway. When over-expressed in maize plants, ARGOS reduces plant sensitivity to ethylene and promotes organ growth, leading to increased drought tolerance (DRT) and improved nitrogen use efficiency (NUE) ((WO 2013/066805 A1, published 10 May 2013). To achieve optimal ethylene sensitivity, promoters have been tested for driving Zm-ARGOS8 over-expression in transgenic maize plants. Field trials showed that a maize promoter, Zm-GOS2 PRO:GOS2 INTRON (SEQ ID NO:460, U.S. Pat. No. 6,504,083 patent issued on Jan. 7, 2003; Zm-GOS2 is a maize homologous gene of rice GOS2. Rice GOS2 stands for Gene from *Oryza Sativa* 2), provided a favorable expression level and tissue coverage for Zm-ARGOS8 and the transgenic plants have a higher grain yield than non-transgenic controls under drought stress and low nitrogen conditions (WO 2013/066805 A1, published 10 May 2013). However, these transgenic plants contain two ARGOS8 genes, the endogenous gene and the transgene. ARGOS8 protein levels, therefore, are determined by these two genes. Because the endogenous ARGOS8 gene varies in sequence and the expression level among different inbred lines, the ARGOS8 protein level will be different when the transgene is integrated into different inbreds. Here we present a mutagenization (gene editing) method to modify the promoter region of the endogenous ARGOS8 gene to attain desired expression patterns and eliminate the need for a transgene.

The promoter Zm-GOS2 PRO:GOS2 INTRON (SEQ ID NO:460; U.S. Pat. No. 6,504,083 patent issued on Jan. 7, 2003) was inserted into the 5'-UTR of Zm-ARGOS8 (SEQ ID NO:462) by using a guideRNA/Cas9 system. The Zm-GOS2 PRO:GOS2 INTRON fragment also included a primer binding site (SEQ ID NO:459) at its 5' end to facilitate event screening with PCR. We also substituted the native promoter of Zm-ARGOS8 (SEQ ID NO:461) with Zm-GOS2 PRO::GOS2 INTRON (SEQ ID NO:460). Resulted maize lines carry a new ARGOS8 allele whose expression levels and tissue specificity will differ from the native form. We expect that these lines will recapitulate the phenotype of increased drought tolerance and improved NUE as observed in the Zm-GOS2 PRO:Zm-ARGOS8 transgenic plants (WO 2013/066805 A1, published 10 May 2013). These maize lines are different from those conventional transgenic events: (1) there is only one ARGOS8 gene in the genome; (2) this modified version of Zm-ARGOS8 resides at its native locus; (3) the ARGOS8 protein level and the tissue specificity of gene expression are entirely controlled by the edited allele. The DNA reagents used during the mutagenization, such as guideRNA, Cas9endonuclease, transformation selection marker and other DNA fragments are not required for function of the newly generated ARGOS8 allele and can be eliminated from the genome by segregation through standard breeding methods. Because the promoter Zm-GOS2 PRO:GOS2 INTRON was copied from maize GOS2 gene (SEQ ID NO:464) and inserted into the ARGOS8 locus through homologous recombination, this ARGOS8 allele is indistinguishable from natural mutant alleles.

A. Insertion of *Zea mays*-GOS2 PRO:GOS2 INTRON into maize-ARGOS 8 Promoter

To insert Zm-GOS2 PRO:GOS2 INTRON into the 5'-UTR of maize ARGOS8 gene, a guideRNA construct, gRNA1, was made using maize U6 promoter and terminator as described herein. The 5'-end of the guide RNA contained a 19-bp variable targeting domain targeting the genomic target sequence 1 (CTS1; SEQ ID NO; 451) in the 5'-UTR of Zm-ARGOS8 (FIG. 28). A polynucleotide modification template containing the Zm-GOS2 PRO:GOS2 INTRON that was flanked by two genomic DNA fragments (HR1 and HR2, 370 and 430-bp in length, respectively) derived from the upstream and downstream region of the CTS1 (FIG. 28). The gRNA1 construct, the polynucleotide modification template, a Cas9 cassette and transformation selection marker phosphomannose isomerase (PMI) were introduced into maize immature embryo cells by using a particle bombardment method. PMI-resistant calli were screened with PCR for Zm-GOS2 PRO:GOS2 INTRON insertion (FIGS. 29A and 29B). Multiple callus events were identified and plants were regenerated. The insertion events were confirmed by amplifying the Zm-ARGOS8 region in T0 plants with PCR (FIG. 29C) and sequencing the PCR products.

B. Replacement of Zm-ARGOS 8 Promoter with Zm-GOS2 PRO:GOS2 INTRON Promoter (Promoter Swap).

To substitute (replace) the native promoter of Zm-ARGOS8 with Zm-GOS2 PRO:GOS2 INTRON, a guide RNA construct, gRNA3, was made for targeting the genomic target site CTS3 (SEQ ID NO:453), located 710-bp upstream of the Zm-ARGOS8 start codon (FIG. 30). Another guide RNA, gRNA2, was designed to target the genomic target site CTS2 (SEQ ID NO:452) located in the 5'-UTR of Zm-ARGOSO8 (FIG. 30). The polynucleotide modification template contained a 400-bp genomic DNA fragment derived from the upstream region of CTS3, Zm-GOS2 PRO:GOS2 INTRON and a 360-bp genomic DNA fragment derived from the downstream region of CTS2 (FIG. 30). The gRNA3 and gRNA2, the Cas9 cassette, the polynucleotide modification template and the PMI selection marker were used to transform immature embryo cells. Multiple promoter swap (promoter replacement) events were identified by PCR screening of the PMI-resistance calli (FIGS. 31A, 31B & 31C) and plants were regenerated. The swap events were confirmed by PCR analysis of the Zm-ARGOS8 region in T0 plants (FIG. 31D).

C. Deletion of Zm-ARGOS 8 Promoter

To delete the promoter of Zm-ARGOS8, we screened the PMI-resistance calli obtained from the above gRNA3/gRNA2 experiment to look for events that produce a 1.1-kb PCR product (FIG. 32A). Multiple deletion events were identified (FIG. 32B) and plants were regenerated. The deletion events were confirmed by amplifying the Zm-ARGOS8 region in T0 plants with PCR and sequencing of the PCR products.

Example 24

Gene Editing of the Soybean EPSPS1 Gene Using the Guide RNA/Cas Endonuclease System A. guideRNA/Cas9 Endonuclease Target Site Design on the Soybean EPSPS Genes.

Two guideRNA/Cas9 endonuclease target sites (soy EPSPS-CR1 and soy EPSPS-CR2) were identified in the Exon2 of the soybean EPSPS1 gene Glyma01 g33660 (Table 33).

TABLE 33

Guide RNA/Cas9 endonuclease target sites on soybean EPSPS1 gene

| Name of gRNA-Cas9 endonuclease target site | Cas endonuclease target sequence (SEQ ID NO:) | Physical location |
|---|---|---|
| soy EPSPS-CR1 | 467 | Gm01: 45865337 . . . 45865315 |
| soy EPSPS-CR2 | 468 | Gm01: 45865311 . . . 45865333 |

B. Guide-RNA Expression Cassettes, Cas9 Endonuclease Expression Cassettes and Polynucleotide Modification Templates for Introduction of Specific Amino Acid Changes in the Soybean EPSPS1 Gene The soybean U6 small nuclear RNA promoter, GM-U6-13.1 (SEQ ID. NO: 469), was used to express guide RNAs to direct Cas9 nuclease to designated genomic target sites (Table 34). A soybean codon optimized Cas9 endonuclease (SEQ ID NO: 489) expression cassette and a guide RNA expression cassette were linked in a first plasmid that was co-delivered with a polynucleotide modification template. The polynucleotide modification template contained specific nucleotide changes that encoded for amino acid changes in the EPSPS1 polypeptide (Glyma01 g33660), such as the T183I and P187S (TIPS) in the Exon2. Other amino acid changes in the EPSPS1 polypeptide can also be obtained using the guide RNA/Cas endonuclease system described herein. Specific amino acid modifications can be achieved by homologous recombination between the genomic DNA and the polynucleotide modification template facilitated by the guideRNA/Cas endonuclease system.

TABLE 34

Guide RNA/Cas9 expression cassettes and polynucleotide modification templates used in soybean stable transformation for the specific amino acid modifications of the EPSPS1 gene.

| Experiment | Guide RNA/Cas9 (plasmid name) | SEQ ID NO: | polynucleotide modification template | SEQ ID NO: |
|---|---|---|---|---|
| soy EPSPS-CR1 | U6-13.1:EPSPS CR1 + EF1A2:CAS9 (QC878) | 470 | RTW1013A | 472 |
| soy EPSPS-CR2 | U6-13.1:EPSPS CR2 + EF1A2:CAS9 (QC879) | 471 | RTW1012A | 473 |

Genomic DNA was extracted from somatic embryo samples and analyzed by quantitative PCR using a 7500 real time PCR system (Applied Biosystems, Foster City, CA) with target site-specific primers and FAM-labeled fluorescence probe to check copy number changes of the double strand break target sites. The qPCR analysis was done in duplex reactions with a syringolide induced protein (SIP) as the endogenous controls and a wild type 93B386 genomic DNA sample that contains one copy of the target site with 2 alleles, as the single copy calibrator. The presence or absence of the guide RNA-Cas9 expression cassette in the transgenic events was also analyzed with the qPCR primer/probes for guideRNA/Cas9 (SEQ IDs: 477-479) and for PinII (SEQ ID: 480-482). The qPCR primers/probes are listed in Table 35.

TABLE 35

Primers/Probes used in qPCR analyses of transgenic soybean events.

| Target Site | Primer/Probe Name | Sequences | SEQ ID NOs: |
|---|---|---|---|
| EPSPS-CR1 & EPSPS-CR2 | Soy1-F1 | CCACTAGTAAGGAATCTAAAGATGAAATCA | 474 |
| | Soy1-R2 | CCTGCAGCAACCACAGCTGCTGTC | 475 |
| | Soy1-T1 (FAM-MGB) | CTGCAATGCGTCCTT | 476 |
| gRNA/CAS9 | Cas9-F | CCTTCTTCCACCGCCTTGA | 477 |
| | Cas9-R | TGGGTGTCTCTCGTGCTTTTT | 478 |
| | Cas9-T (FAM-MGB) | AATCATTCCTGGTGGAGGA | 479 |
| pINII | pINII-99F | TGATGCCCACATTATAGTGATTAGC | 480 |
| | pINII-13R | CATCTTCTGGATTGGCCAACTT | 481 |
| | pINII-69T (FAM-MGB) | ACTATGTGTGCATCCTT | 482 |
| SIP | SIP-130F | TTCAAGTTGGGCTTTTTCAGAAG | 483 |
| | SIP-198R | TCTCCTTGGTGCTCTCATCACA | 484 |
| | SIP-170T (VIC-MGB) | CTGCAGCAGAACCAA | 485 |

The endogenous control probe SIP-T was labeled with VIC and the gene-specific probes for all the target sites were labeled with FAM for the simultaneous detection of both fluorescent probes (Applied Biosystems). PCR reaction data were captured and analyzed using the sequence detection software provided with the 7500 real time PCR system and the gene copy numbers were calculated using the relative quantification methodology (Applied Biosystems).

Since the wild type 93B86 genomic DNA with two alleles of the double strand break target site was used as the single copy calibrator, events without any change of the target site would be detected as one copy herein termed Wt-Homo (qPCR value>=0.7), events with one allele changed, which is no longer detectable by the target site-specific qPCR, would be detected as half copy herein termed NHEJ-Hemi (qPCR value between 0.1 and 0.7), while events with both alleles changed would be detected as null herein termed NHEJ-Null (qPCR value=<0.1). As shown in Table 36, both guideRNA/Cas endonuclease systems targeting the soy EPSPS-CR1 and EPSPS-CR2 sites can introduce efficient Double Strand Break (DSB) efficiency at their designed target sites. Both NHEJ-Hemi and NHEJ-Null were detected in the 93B86 genotype. NHEJ (Non-Homologous-End-Joining) mutations mediated by the guide RNA/Cas9 system at the specific Cas9 target sites were confirmed by PCR/topo cloning/sequencing.

TABLE 36

Target Site Double Strand Break Rate Mutations Induced by the Guide RNA/Cas9 system on soybean EPSPS1 gene. Numbers indicate no. of events (numbers in parentheses are %).

| Project | Total event | Wt-Homo (%) | NHEJ-Hemi (%) | NHEJ-Null (%) |
|---|---|---|---|---|
| U6-13.1 EPSPS-CR1 | 168 | 63 (38%) | 66 (39%) | 39 (23%) |

TABLE 36-continued

Target Site Double Strand Break Rate Mutations Induced by the Guide
RNA/Cas9 system on soybean EPSPS1 gene. Numbers indicate no.
of events (numbers in parentheses are %).

| Project | Total event | Wt-Homo (%) | NHEJ-Hemi (%) | NHEJ-Null (%) |
|---|---|---|---|---|
| U6-13.1 EPSPS-CR2 | 111 | 50 (45%) | 21 (19%) | 40 (36%) |

D. Detection of the TIPS Mutation in the Soybean EPSPS Gene

In order to edit specific amino acids at the native EPSPS gene (such as those resulting in a TIPS modification), a polynucleotide modification template, such as RTW1013A or RTW1012A (Table 34), was co-delivered with the guideRNA/Cas9 expression cassettes into soybean cells.

The modification of the native EPSPS1 gene via guide RNA/Cas9 system mediated DNA homologous recombination was determined by specific PCR analysis. A specific PCR assay with primer pair WOL569 (SEQ ID NO: 486) and WOL876 (SEQ ID NO: 487) was used to detect perfect TIPS modification at the native EPSPS1 gene. A second primer pair WOL569 (SEQ ID NO: 486) and WOL570 (SEQ ID NO: 488) was used to amplify both TIPS modified EPSPS1 allele and WT (wild type)/NHEJ mutated allele. Topo cloning/sequencing was used to verify the sequences.

Example 25

Intron Replacement of Soybean Genes Using the Guide RNA/Cas Endonuclease System
A. guideRNA/Cas9 Endonuclease Target Site Design.

Four guideRNA/Cas9 endonuclease target sites were identified in the soybean EPSPS1 gene Glyma01 g33660 (Table 37). Two of the target sites (soy EPSPS-CR1 and soy EPSPS-CR2) were identified to target the Exon2 of the soybean EPSPS gene as described in Example 24. Another two target sites (soy EPSPS-CR4 and soy EPSPS-CR5) were designed near the 5' end of the intron1 of the soybean EPSPS gene.

TABLE 37

Guide RNA/Cas9 endonuclease target sites on soybean EPSPS1 gene.

| Name of gRNA-Cas9 endonuclease target site | Cas endonuclease target sequence (SEQ ID NO:) | Physical location |
|---|---|---|
| soy EPSPS-CR1 | 467 | Gm01: 45865337..45865315 |
| soy EPSPS-CR2 | 468 | Gm01: 45865311..45865333 |
| soy EPSPS-CR4 | 490 | Gm01: 45866302..45866280 |
| soy EPSPS-CR5 | 491 | Gm01: 45866295..45866274 |

B. Guide RNA/Cas9 Endonuclease Expression Cassettes and Polynucleotide Modification Templates Used in Soybean Stable Transformation for the Replacement of the Intron1 of the Soybean EPSPS1 Gene with the Soybean Ubiquitin (UBQ) Intron1

The soybean U6 small nuclear RNA promoter GM-U6-13.1 (SEQ ID NO: 469) was used to express two guide RNAs (soy-EPSPS-CR1 and soy-EPSPS-CR4, or soy-EPSPS-CR1 and soy-EPSPS-CR5) to direct Cas9 endonuclease to designated genomic target sites (Table 38). One of the target sites (soy-EPSPS-CR1) was located in the exon2, as described in Example 24, and a second target site (soy-EPSPS-CR4 or soy-EPSPS-CR5) was located near the 5' end of intron1 of the native EPSPS1 gene. A soybean codon optimized Cas9 endonuclease expression cassette and a guide RNA expression cassette were linked in the expression plasmids QC878/RTW1199 (SEQ ID NO:470/492) or QC878/RTW1200 (SEQ ID NO:470/493) that was co-delivered with a polynucleotide modification template. The polynucleotide modification template, RTW1190A (SEQ ID NO:494), contained 532 bp intron1 of the soybean UBQ gene and the TIPS modified Exon2. Soybean EPSPS1 intron 1 replacement with the soybean UBQ intron1 can be achieved with the guide RNA/Cas system by homologous recombination between the genomic DNA and the polynucleotide modification template, resulting in enhancement of the native or modified soy EPSPS1 gene expression.

TABLE 38

Guide RNA/Cas9 endonuclease expression cassettes and polynucleotide modification templates used in soybean stable transformation for the replacement of the Intron1 of the soybean EPSPS1 gene with the soybean ubiquitin (UBQ) intron1

| Experiment | Guide RNA/Cas9 | SEQ ID NO: | poly-nucleotide modification template | SEQ ID NO: |
|---|---|---|---|---|
| soy EPSPS-CR1 and soy EPSPS-CR4 | U6-13.1:EPSPS CR1 + CR4 + EF1A2:CAS9 (QC878/RTW1199) | 470/492 | RTW1190A | 494 |
| soy EPSPS-CR1 and soy EPSPS-CR5 | U6-13.1:EPSPS CR1 + CR5 + EF1A2:CAS9 (QC878/RTW1200) | 470/493 | RTW1190A | 494 |

C. Detection of Site-Specific NHEJ Mediated by the Guide RNA/Cas9 System in Stably Transformed Soybean Site-specific NHEJ was detected as described in Example 24 C, using the qPCR primers/probes listed in Table 39.

TABLE 39

Primers/Probes used in qPCR analyses of transgenic soybean events.

| Target Site | Primer/Probe Name | Sequences | SEQ ID NOs: |
|---|---|---|---|
| EPSPS-CR1 & EPSPS-CR2 | Soy1-F1 | CCACTAGTAAGGAATCTAAAGATGAAATCA | 474 |
| | Soy1-R2 | CCTGCAGCAACCACAGCTGCTGTC | 475 |
| | Soy1-T1 (FAM-MGB) | CTGCAATGCGTCCTT | 476 |

TABLE 39-continued

Primers/Probes used in qPCR analyses of transgenic soybean events.

| Target Site | Primer/Probe Name | Sequences | SEQ ID NOs: |
|---|---|---|---|
| EPSPS-CR4 | Soy1-F3 | GTTTGTTTGTTGTTGGGTGTGGG | 495 |
|  | Soy1-R3 | GACATGATGCTTCATTTTCACAGAA | 496 |
|  | Soy-T2 (FAM-MGB) | TGTGTAGAGTGGATTTTG | 497 |
| EPSPS-CR5 | Soy1-F2 | TGTTGTTGGGTGTGGGAATAGG | 498 |
|  | Soy1-R3 | GACATGATGCTTCATTTTCACAGAA | 496 |
|  | Soy1-T2 (FAM-MGB) | TGTGTAGAGTGGATTTTG | 497 |
| gRNA/CAS9 | Cas9-F | CCTTCTTCCACCGCCTTGA | 477 |
|  | Cas9-R | TGGGTGTCTCTCGTGCTTTTT | 478 |
|  | Cas9-T (FAM-MGB) | AATCATTCCTGGTGGAGGA | 479 |
| pINII | pINII-99F | TGATGCCCACATTATAGTGATTAGC | 480 |
|  | pINII-13R | CATCTTCTGGATTGGCCAACTT | 481 |
|  | pINII-69T (FAM-MGB) | ACTATGTGTGCATCCTT | 482 |
| SIP | SIP-130F | TTCAAGTTGGGCTTTTTCAGAAG | 483 |
|  | SIP-198R | TCTCCTTGGTGCTCTCATCACA | 484 |
|  | SIP-170T (VIC-MGB) | CTGCAGCAGAACCAA | 485 |

D. Detection of the Replacement of the Soybean EPSPS1 Intron1 with the Soybean UBQ Intron1 Using the Guide RNA/Cas9 Endonuclease System.

In order to replace the soybean EPSPS1 intron1 with the soybean UBQ intron1 at the native EPSPS1 gene, two guideRNA expression vectors were used as shown in Table 38. The QC878 vector (SEQ ID NO: 470) was targeting the exon2 and the RTW1199 (SEQ ID NO:492) or RTW1200 (SEQ ID NO:493) was targeting the 5' end of the intron1. The double cleavage of soybean EPSPS gene with the two guide RNA/Cas systems resulted in the removal of the native EPSPS1 intron1/partial Exon2 fragment. At the same time, a polynucleotide modification template RTW1190A (SEQ ID NO:494) was co-delivered into soybean cells and homologous recombination between the polynucleotide modification template and the genomic DNA resulted in the replacement of EPSPS1 intron1 with the soybean UBQ intron1 and the desired amino acid modifications in exon2 as evidenced by PCR analysis. PCR assays with primer WOL1001/WOL1002 pair (SEQ ID NO: 499 and 500) and WOL1003/WOL1004 pair (SEQ ID NO: 501 and 502) were used to detect the intron replacement events.

Example 26

Promoter Replacement (Promoter Swap) of Soybean Genes Using the GuideRNA/Cas Endonuclease System A. guideRNA/Cas9 Endonuclease Target Site Design.

Four guideRNA/Cas9 endonuclease target sites were identified in the soybean EPSPS1 gene Glyma01 g33660 (Table 40). Two of the target sites (soy EPSPS-CR1 and soy EPSPS-CR2) were identified to target the Exon2 of the soybean EPSPS gene as described in Example 24. The soy EPSPS-CR6 and soy EPSPS-CR7 were identified near the 5' end of the −798 bp of the native EPSPS promoter.

TABLE 40

Guide RNA/Cas9 endonuclease target sites on soybean EPSPS1 gene.

| Name of gRNA-Cas9 endonuclease target site | Cas endonuclease target sequence (SEQ ID NO:) | Physical location |
|---|---|---|
| soy EPSPS-CR1 | 467 | Gm01: 45865337..45865315 |
| soy EPSPS-CR2 | 468 | Gm01: 45865311..45865333 |
| soy EPSPS-CR6 | 503 | Gm01: 45867471..45867493 |
| soy EPSPS-CR7 | 504 | Gm01: 45867459..45867481 |

B. Guide RNA/Cas9 Endonuclease Expression Cassettes and Polynucleotide Modification Templates Used in Soybean Stable Transformation for the Replacement of the −798 bp Soybean EPSPS1 Promoter with the Soybean UBQ Promoter.

The soybean U6 small nuclear RNA promoter GM-U6-13.1 (SEQ ID. NO: 469) was used to express two guide RNAs (soyEPSPS-CR1 and soyEPSPS-CR6, or soyEPSPS-CR1 and soyEPSPS-CR7) to direct Cas9 nuclease to designated genomic target sites (Table 41). One of the target sites (soy-EPSPS-CR1) was located in the exon2 as described in Example 24 and a second target site (soy-EPSPS-CR6 or soy-EPSPS-CR7) was located near 5' end of the −798 bp of the native EPSPS1 promoter. A soybean codon optimized Cas9 endonuclease expression cassette and a guide RNA expression cassette were linked in the expression plasmids QC878/RTW1201 (SEQ ID NO:470/505) or QC878/RTW1202 (SEQ ID NO:470/506) that was co-delivered with a polynucleotide modification template, RTW1192A (SEQ ID NO:507). The polynucleotide modification template contained 1369 bp of the soybean UBQ gene promoter, 47 bp 5UTR and 532 bp UBQ intron1. Specific soybean EPSPS1 promoter replacement with the soybean UBQ promoter can be achieved with the guide RNA/Cas system by homologous recombination between the genomic DNA and the polynucleotide modification template, resulting enhancement of the native or modified soy EPSPS1 gene expression

TABLE 41

Guide RNA/Cas9 endonuclease expression cassettes and polynucleotide modification templates used in soybean stable transformation for the replacement of the −798 bp soybean EPSPS1 promoter with the soybean UBQ promoter

| Experiment | Guide RNA/Cas9 | SEQ ID NO: | polynucleotide modification template | SEQ ID NO: |
|---|---|---|---|---|
| soy EPSPS-CR1 and soy EPSPS-CR6 | U6-13.1:EPSPS CR1 + CR6 + EF1A2:CAS9 (QC878/RTW1201) | 470, 505 | RTW1192A | 507 |
| soy EPSPS-CR1 and soy EPSPS-CR7 | U6-13.1:EPSPS CR1 + CR7 + EF1A2:CAS9 (QC878/RTW1202) | 470, 506 | RTW1192A | 507 |

C. Detection of Site-Specific NHEJ Mediated by the Guide RNA/Cas9 System in Stably Transformed Soybean Site-specific NHEJ was detected as described in Example 24 C, using the qPCR primers/probes listed in Table 42.

TABLE 42

Primers/Probes used in qPCR analyses of transgenic soybean events

| Target Site | Primer/Probe Name | Sequences | SEQ ID NOs: |
|---|---|---|---|
| EPSPS-CR1 & EPSPS-CR12 | Soy1-F1 | CCACTAGTAAGGAATCTAAAGATGAAATCA | 474 |
| | Soy1-R2 | CCTGCAGCAACCACAGCTGCTGTC | 475 |
| | Soy1-T1 (FAM-MGB) | CTGCAATGCGTCCTT | 476 |
| EPSPS-CR6 & EPSPS-CR7 | Soy1-F4 | TCAATAATACTACTCTCTTAGACACCAAACAA | 508 |
| | Soy1-R4 | CAAGGAAAATGAATGATGGCTTT | 509 |
| | Soy1-T3 (FAM-MGB) | CCTTCCCAAACTATAATC | 510 |
| gRNA/CAS9 | Cas9-F | CCTTCTTCCACCGCCTTGA | 477 |
| | Cas9-R | TGGGTGTCTCTCGTGCTTTTT | 478 |
| | Cas9-T (FAM-MGB) | AATCATTCCTGGTGGAGGA | 479 |
| pINII | pINII-99F | TGATGCCCACATTATAGTGATTAGC | 480 |
| | pINII-13R | CATCTTCTGGATTGGCCAACTT | 481 |
| | pINII-69T (FAM-MGB) | ACTATGTGTGCATCCTT | 482 |
| SIP | SIP-130F | TTCAAGTTGGGCTTTTTCAGAAG | 483 |
| | SIP-198R | TCTCCTTGGTGCTCTCATCACA | 484 |
| | SIP-170T (VIC-MGB) | CTGCAGCAGAACCAA | 485 |

D. Detection of the Promoter Replacement of the Soybean EPSPS1 Promoter with the Soybean UBQ Promoter Using the Guide RNA/Cas9 Endonuclease System.

In order to replace the soybean EPSPS1 promoter with the soybean UBQ promoter at the native EPSPS1 gene, two guideRNA expression vectors were used in each soybean transformation experiment as shown in Table 41. The QC878 (SEQ ID NO: 470) was targeting the exon2 and the RTW1201 (SEQ ID NO: 505) or RTW1202 (SEQ ID NO: 506) was targeting the 5' end of the soybean −798 bp promoter. The double cleavage of the soybean EPSPS1 gene with the two guide RNA/Cas systems resulted in removal of the native EPSPS1 promoter/5'UTR-Exon1/Intron1/partial Exon2 fragment at the native EPSPS gene. At the same time, a polynucleotide modification template RTW1192A (SEQ ID NO: 507) was co-delivered into soybean cells. This RTW1192A DNA contained 1369 bp soybean UBQ promoter, its 47 bp 5-UTR and 532 bp UBQ intron1 in front of the EPSPS1 exon1-Intron1-modified Exon2. Homologous recombination between the polynucleotide modification template and the genomic DNA resulted in the replacement of EPSPS1 promoter/5'UTR with the soybean UBQ promoter/5'UTR/Intron1 and the desired amino acid modifications evidenced by PCR analysis. PCR assays with primer WOL1005/WOL1006 pair (SEQ ID NO: 511 and 512) and WOL1003/WOL1004 pair (SEQ ID NO: 501 and 502) were used to detect the promoter replacement events.

Example 27

Enhancer Element Deletions Using the GuideRNA/Cas Endonuclease System

The guide RNA/Cas endonuclease system described herein can be used to allow for the deletion of a promoter element from either a transgenic (pre-existing, artificial) or endogenous gene. Promoter elements, such enhancer elements, or often introduced in promoters driving gene expression cassettes in multiple copies (3×=3 copies of enhancer element, FIG. 33) for trait gene testing or to produce transgenic plants expressing specific trait. Enhancer elements can be, but are not limited to, a 35S enhancer element (Benfey et al, EMBO J, August 1989; 8(8): 2195-2202, SEQ ID NO:513). In some plants (events), the enhancer elements can cause an unwanted phenotype, a yield drag, or a change in expression pattern of the trait of interest that is not desired. For example, as shown in FIG. 33, a plant comprising multiple enhancer elements (3 copies, 3×) in its genomic DNA located between two trait cassettes (Trait A en Trait B) was characterized to show an unwanted phenotype. It is desired to remove the extra copies of the enhancer element while keeping the trait gene cassettes intact at their integrated genomic location. The guide RNA/Cas endonuclease system described herein can be used to removing the unwanted enhancing element from the plant genome. A guide RNA can be designed to contain a variable targeting region targeting a target site sequence of 12-30 bps adjacent to a NGG (PAM) in the enhancer. If a Cas endonuclease target site sequence is present in all copies of the enhancer elements (such as the three Cas endonuclease target sites 35S-CRTS1 (SEQ ID NO:514), 35S-CRTS2 (SEQ ID NO:515), 35S-CRTS3 (SEQ ID NO:516)), only one guide RNA is needed to guide the Cas endonuclease to the target sites and induce a double strand break in all the enhancer elements at once. The Cas endonuclease can make cleavage to remove one or multiple enhancers. The guideRNA/Cas endonuclease system can introduced by either *agrobacterium* or particle gun bombardment. Alternatively, two different guide RNAs (targeting two different genomic target sites) can be used to remove all 3× enhancer elements from the genome of an organism, in a manner similar to the removal of a (transgenic or endogenous) promoter described herein.

Example 28

Regulatory Sequence Modifications Using the Guide RNA/Cas Endonuclease System
A. Modification of Polyubiquitination Sites There are defined ubiquitination sites on proteins to be degraded and they were found within the maize EPSPS protein by using dedicated computer programs (for example, the CKSAAP_UbSite (Ziding Zhang's Laboratory of Protein Bioinformatics College of Biological Sciences, China Agricultural University, 100193 Beijing, China). One of the selected polyubiquitination site within the maize EPSPS coding sequence is shown in FIG. 34A and its amino acid signature sequence is compared to the equivalent EPSPS sites from the other plants (FIG. 34A). The lysine amino acid (K) at position 90 (highly conserved in other plant species) was selected as a potential site of the EPSPS protein polyubiquitination. The polynucleotide modification template (referred to as EPSPS polynucleotide maize K90R template) used to edit the epsps locus is listed as SEQ ID NO: 517. This template allowed for editing the epsps locus to contain the lysine (K) to arginine (R) substitution at position 90 (K90R) and two additional TIPS substitutions at positions 102 and 106 (FIGS. 34B and 34C). Maize genomic DNA was edited using the guideRNA/Cas endonuclease system described herein and T0 plants were produced as described herein. The T0 plants that contained the nucleotide modifications, as specified by the information provided on the K90R template (FIG. 34C), were selected by the genotyping methods described herein. F1 EPSPS-K90R plants can be selected for elevated protein content due to a slower rate of the EPSPS protein degradation.
B. Editing Intron Elements to Introduce Intron Mediated Enhancer Elements (IMEs)

Transcriptional activity of the native EPSPS gene can be modulated by transcriptional enhancers positioned in the vicinity of other transcription controlling elements. Introns are known to contain enhancer elements affecting the overall rate of transcription from native promoters including the EPSPS promoter. For example, the first intron of the maize ubiquitin 5'UTR confers a high level of expression in monocot plants as specified in the WO 2011/156535 A1 patent application. An intron enhancing motif CATATCTG (FIG. 35 A), also referred to as a intron-mediated enhancer element, IME was identified by proprietary analysis (WO2011/156535 A1, published on Dec. 15, 2011) and appropriate nucleotide sites at the 5' end of the EPSPS first intron were selected for editing in order to introduce the intron-mediated enhancer elements (IMEs) (FIG. 35B-35C). The polynucleotide modification template (referred to as EPSPS polynucleotide maize IME template) is listed as SEQ ID No: 518. The polynucleotide modification template allows for editing of the epsps locus to contain three IMEs (two on one strand of the DNA, one on the reverse strand) in the first EPSPS intron and the TIPS substitutions at positions 102 and 106. The genomic DNA of maize plants was edited using the guideRNA/Cas endonuclease system described herein. Maize plants containing the IME edited EPSPS coding sequence can be selected by genotyping the T0 plants and can be further evaluated for elevated EPSPS-TIPS protein content due to the enhanced transcription rate of the native EPSPS gene.

Example 29

Modifications of Splicing Sites and/or Introducing Alternate Splicing Sites Using the Guide RNA/Cas Endonuclease System In maize cells, the splicing process is affected by splicing sites at the exon-intron junction sites as illustrated in the EPSPS mRNA production (FIG. 36A-36B). FIG. 36A shows analysis of EPSPS amplified pre-mRNA (cDNA panel on left). Lane I4 in FIG. 36A shows amplification of the EPSPS pre-mRNA containing the $3^{rd}$ intron unspliced, resulting in a 804 bp diagnostic fragment indicative for an alternate splicing event. Lanes E3 and F8 show the EPSPS PCR amplified fragments resulting from regular spliced introns. Diagnostic fragments such as the 804 bp fragment of lane 14 are not amplified unless cDNA is synthesized (as is evident by the absence of bands in lanes E3, I4, and F8 comprising total RNA (shown in the total RNA panel on right of FIG. 36A). The canonical splice site in the maize EPSPS gene and genes from other species is AGGT, while other (alterative) variants of the splice sites may lead to the aberrant processing of pre-mRNA molecules. The EPSPS coding sequence contains a number of alternate splicing sites that may affect the overall efficiency of the pre-mRNA maturation process and as such may limit the EPSPS protein accumulation in maize cells.

In order to limit the occurrence of alternate splicing events during EPSPS gene expression, a guideRNA/Cas endonuclease system as described herein can be used to edit splicing sites. The splicing site at the junction of the second native EPSPS intron and the third exon is AGTT and can be edited in order to introduce the canonical AGGT splice site at this junction (FIG. 37). The T>G substitution does not affect the native EPSPS open reading frame and it does not change the EPSPS amino acid sequence. The polynucleotide modification template (referred to as EPSPS polynucleotide maize Tspliced template) is listed as SEQ ID NO: 519. This polynucleotide modification template allows for editing of the epsps locus to contain the canonical AGGT splice site at the $2^{nd}$ intron-$3^{rd}$ exon junction site and the TIPS substitutions at positions 102 and 106. Maize plants are edited using the procedures described herein. F1 EPSPS-Tspliced maize plants can be evaluated for increased protein content due to the enhanced production of functional EPSPS mRNA messages.

Example 30

Shortening Maturity Via Manipulation of Early Flowering Phenotype with ZmRap2.7 Down-Regulation Using the Guide RNA/Cas Endonuclease System Overall plant maturity can be shortened by modulating the flowering time phenotype of plants through modulation of a maize ZmRap2.7 gene. Shortening of plant maturity can be obtained by an early flowering phenotype.

RAP2.7 is an acronym for Related to APETALA 2.7. RAPL means RAP2.7 LIKE and RAP2.7 functions as an AP2-family transcription factor that suppresses floral transition (SEQ ID NOs:520 and 521). Transgenic phenotype upon silencing or knock-down of Rap2.7 resulted in early flowering, reduced plant height, but surprisingly developed normal ear and tassel as compared the wild-type plants (PCT/US14/26279 application, filed Mar. 13, 2014). The guide RNA/Cas endonuclease system described herein can be used to target and induce a double strand break at a Cas endonuclease target site located within the RAP2.7 gene. Plants comprising NHEJ within the RAP2.7 gene can be selected and evaluated for the presence of a shortened maturity phenotype.

Example 31

Modulating Expression of a Maize NPK1B Gene for Engineering Frost Tolerance in Maize Using a Guide RNA/Cas Endonuclease System Nicotiana Protein Kinase1 (NPK1) is a mitogen activated protein kinase kinase kinase that is involved in cytokinesis regulation and oxidative stress signal transduction. The ZM-NPK1B (SEQ ID NO: 522 and SEQ ID NO: 523) which has about 70% amino acid similarity to rice NPKL3 has been tested for frost tolerance in maize seedlings and reproductive stages (PCT/US14/26279 application, filed Mar. 13, 2014). Transgenic seedlings and plants comprising a ZM-NPK1B driven by an inducible promoter Rab17, had significantly higher frost tolerance than control seedlings and control plants. The gene seemed inducted after cold acclimation and during −3° C. treatment period in most of the events but at low levels. (PCT/US14/26279 application, filed Mar. 13, 2014).

A guide RNA/Cas endonuclease system described herein can be used to replace the endogenous promoter of NPK1 gene, with a stress-inducible promoter such as the maize RAB17 promoter stages (SEQ ID NO: 524; PCT/US14/26279 application, filed Mar. 13, 2014), thus modulate NPK1B expression in a stress-responsive manner and provide frost tolerance to the modulated maize plants.

Example 32

Shortening Maturity Via Manipulation of Early Flowering Phenotype with FTM1 Expression Using a Guide RNA/Cas Endonuclease Systems Overall plant maturity can shortened by modulating the flowering time phenotype of plants through expressing a transgene. Such a phenotype modification can also be achieved with additional transgenes or through a breeding approach.

FTM1 stands for Floral Transition MADS 1 transcription factor (SEQ ID NOs: 525 and 526). It is a MADS Box transcriptional factor and induces floral transition. Upon expression of FTM1 under a constitutive promoter, transgenic plants exhibited early flowering and shortened maturity, but surprisingly ear and tassel developed normally as compared to the wild-type plants (PCT/US14/26279 application, filed Mar. 13, 2014).

FTM1-expressing maize plants demonstrated that by manipulating a floral transition gene, time to flowering can be reduced significantly, leading to a shortened maturity for the plant. As maturity can be generally described as time from seeding to harvest, a shorter maturity is desired for ensuring that a crop can finish in the northern continental dry climatic environment (PCT/US14/26279 application, filed Mar. 13, 2014).

A guide RNA/Cas endonuclease system described herein can be used to introduce enhancer elements such as the CaMV35S enhancers (Benfey et al, EMBO J, August 1989; 8(8): 2195-2202, SEQ ID NO:512), specifically targeted in front of the endogenous promoter of FTM1, in order to enhance the expression of FTM1 while preserving most of the tissue and temporal specificities of native expression, providing shortened maturity to the modulated plants.

Example 33

Inserting Inducible Responsive Elements in Plant Genomes

Inducible expression systems controlled by an external stimulus are desirable for functional analysis of cellular proteins as well as trait development as changes in the expression level of the gene of interest can lead to an accompanying phenotype modification. Ideally such a system would not only mediate an "on/off" status for gene expression but would also permit limited expression of a gene at a defined level.

The guide RNA/Cas endonuclease system described herein can be used to introduce components of repressor/operator/inducer systems to regulate gene expression of an organism. Repressor/operator/inducer systems and their components are well known I the art (US 2003/0186281 published Oct. 2, 2003; U.S. Pat. No. 6,271,348). For example, nut not limited to, components of the tetracycline (Tc) resistance system of E. coli have been found to function in eukaryotic cells and have been used to regulate gene expression (U.S. Pat. No. 6,271,348) Nucleotide sequences of tet operators of different classes are known in the art see for example: classA, calssB, classC, classD, classE TET operator sequences listed as SEQ ID NOs:11-15 of U.S. Pat. No. 6,271,348.

Components of a sulfonylurea-responsive repressor system (as described in U.S. Pat. No. 8,257,956, issued on Sep. 4, 2012) can also be introduced into plant genomes to generate a repressor/operator/inducer systems into said plant where polypeptides can specifically bind to an operator, wherein the specific binding is regulated by a sulfonylurea compound.

Example 34

Genome Deletion for Trait Locus Characterization

Trait mapping in plant breeding often results in the detection of chromosomal regions housing one or more genes controlling expression of a trait of interest. For quantitative traits, expression of a trait of interest is governed by multiple quantitative trait loci (QTL) of varying effect-size, complexity, and statistical significance across one or more chromosomes. A QTL or haplotype that is associated with suppression of kernel-row number in the maize ear can be found to be endemic in elite breeding germplasm. The negative effect of this QTL for kernel row number can be fine-mapped to an acceptable resolution to desire selective elimination of this negative QTL segment within specific recipient germplasm. Two flanking cut sites for the guide polynucleotide/Cas endonuclease system are designed via haplotype, marker, and/or DNA sequence context at the targeted QTL region, and the two guide polynucleotide/Cas endonuclease systems are deployed simultaneously or sequentially to produce the desired end product of two independent double strand breaks (cuts) that liberate the intervening region from the chromosome. Individuals harboring the desired deletion event would result by the NHEJ repair of the two chromosomal ends and eliminating the intervening DNA region. Assays to identify these individuals is based on the presence of flanking DNA marker regions, but absence of intervening DNA markers. A proprietary haplotype for kernel-row-number is created that is not extant in the previously defined elite breeding germplasm pool.

An alternative approach would be to delete a region containing a fluorescent gene. Recovery of plants with, and without, fluorescence would give an approximate indication of the efficiency of the deletion process.

Example 35

Engineering Drought Tolerance and Nitrogen Use Efficiency into Maize Via Gene Silencing by Expressing an Inverted Repeat into an ACS6 Gene Using the Guide RNA/Cas Endonuclease System ACC (1-aminocyclopropane-1-carboxylic acid) synthase (ACS) genes encode enzymes that catalyze the rate limiting step in ethylene biosynthesis. A construct containing one of the maize ACS genes, ZM-ACS6, in an inverted repeat configuration, has been extensively tested for improved abiotic stress tolerance in maize (PCT/US2010/051358, filed Oct. 4, 2010; PCT/US2010/031008, filed Apr. 14, 2010). Multiple transgenic maize events containing a ZM-ACS6 RNAi sequence driven by a ubiquitin constitutive promoter had reduced ethylene emission, and a concomitant increase in grain yield relative to controls under both drought and low nitrogen field conditions (Plant Biotechnology Journal: 12 Mar. 2014, DOI: 10.1111/pbi.12172).

In an embodiment the insertion of the inverted gene fragment can result in the formation of an in-vivo created inverted repeat (hairpin) in a native (or modified) promoter of an ACS6 gene and/or in a native 5' end of the native ACS6 gene. The inverted gene fragment can further comprise an intron which can result in an enhanced silencing of the targeted ethylene biosynthetic gene.

Example 36

T0 Plants from the Multiplexed Guide RNA/Cas Experiment Carried High Frequency of Bi-Allelic Mutations and Demonstrated Proper Inheritance of Mutagenized Alleles in the T1 Population This example demonstrates the high efficiency of the guide RNA/Cas endonuclease system in generating maize plants with multiple mutagenized loci and their inheritance in the consecutive generation(s).

Mutated events generated in the multiplexed experiment described in Example 4 were used to regenerate T0 plants with mutations at 3 different target sites: MS26Cas-2 target site (SEQ ID NO: 14), LIGCas-3 target site (SEQ ID NO: 18) and MS45Cas-2 target site (SEQ ID NO: 20).

For further analysis, total genomic DNA was extracted from leaf tissue of individual T0 plants. Fragments spanning all 3 target sites were PCR amplified using primer pairs for the corresponding target sites, cloned into the pCR2.1-TOPO cloning vector (Invitrogen), and sequenced. Table 43 shows examples of mutations detected in four T0 plants resulting from imprecise NHEJ at all relevant loci when multiple guide RNA expression cassettes were simultaneously introduced either in duplex (see TS=Lig34/MS26) or triplex (see TS=Lig34/MS26/MS45), respectively.

TABLE 43

Examples of mutations at maize target loci produced by a multiplexed guide RNA/Cas system

| Target sites (TS) | T0 plant | qPCR data | Sequencing data | | |
|---|---|---|---|---|---|
| | | | Lig3/4 TS | Ms26 TS | Ms45 TS |
| Lig34/MS26 | 1 | NULL/NULL* | 1 bp ins/2 bp del + 1 bp ins | 1 bp ins/19 bp del | |
| | 2 | NULL/NULL | 1 bp ins/1 bp del | 1 bp ins/1 bp ins | |
| Lig34/MS26/ MS45 | 1 | NULL/NULL/ NULL | 1 bp ins/large del | 1 bp ins/1 bp del | 15 bp del/ large del |
| | 2 | INDEL**/NULL/ NULL | 1 bp ins/WT | 1 bp (T) ins/ 1 bp (C) ins | 1 bp ins/large del |

*NULL indicates that both alleles are mutated
**INDEL indicates mutation in one of the two alleles.
del = deletion,
ins = insertion,
bp = base pair All T0 plants were crossed with wild type maize plants to produce T1 seeds. T1 progeny plants (32 plants) of the second T0 plant from the triplex experiment (see Table 43, Lig34/MS26/MS45) were analyzed by sequencing to evaluate segregation frequencies of the mutated alleles. Our results demonstrated proper inheritance and expected (1:1) segregation of the mutated alleles as well as between mutated and wild type alleles at all three target sites.

The data clearly demonstrate that the guide RNA/maize optimized Cas endonuclease system described herein, can be used to simultaneously mutagenize multiple chromosomal loci and produce progeny plants containing the stably inherited multiple gene knock-outs.

Example 37

Guide RNA/Cas Endonuclease Mediated DNA Cleavage in Maize Chromosomal Loci can Stimulate Homologous Recombination Repair-Mediated Transgene Insertion and Resulting T1 Progeny Plants Demonstrated Proper Inheritance of the Modified Alleles Maize events generated in the experiment described in Example 5 were used to regenerate T0 plants. T0 plants were regenerated from 7 independent callus events with correct amplifications across both transgene genomic DNA junctions and analyzed. Leaf tissue was sampled, total genomic DNA extracted, and PCR amplification at both transgene genomic DNA junctions was carried out using the primer pairs (corresponding to SEQ ID NOs: 98-101). The resulting amplification products were sequenced for confirmation. Plants with confirmed junctions at both ends were further analyzed by Southern hybridization (FIG. 38) using two probes, genomic (outside HR1 region, SEQ ID: 533) and transgenic (within MoPAT gene, SEQ ID: 534). PCR, sequencing and Southern hybridization data demonstrated that plants regenerated from two of the 7 events (events 1 and 2) demonstrated perfect, clean, single copy transgene integration at the expected target site via homologous recombination. Plants regenerated from the remaining 5 events contained either additional, randomly integrated copies of the transgene (events 4, 5, and 6) or rearranged copies of the transgene integrated into the target site (events 3 and 7).

T0 plants from events 1 and 2 were crossed with wild type maize plants to produce T1 seeds. Ninety-six T1 plants from events 1 and 2 were analyzed by Southern hybridization (using the same probes as above) to evaluate segregation frequencies of the transgene locus. Southern results demonstrated proper inheritance and expected (1:1) segregation of the transgene and wild type loci.

The data clearly demonstrate that maize chromosomal loci cleaved with the maize optimized guide RNA/Cas system described herein can be used to stimulate HR repair pathways to site-specifically insert transgenes and produce progeny plants that have the inserted transgene stably inherited.

Example 38

Production of Maize Transgenic Lines with Pre-Integrated Cas9 for Transient Delivery of Guide RNA This example describes the rationale, production, and testing of maize transgenic lines with an integrated Cas9 gene under constitutive and temperature inducible promoters.

As demonstrated in Example 2, a high mutation frequency was observed when Cas9 endonuclease and guide RNA were delivered as DNA vectors by biolistic transformation to immature corn embryo cells. When Cas9 endonuclease was delivered as a DNA vector and guide RNA as RNA molecules, a reduced mutation frequency was observed (Table 44).

TABLE 44

Mutant reads at LigCas-3 target site produced by transiently delivered guide RNA.

| Target Site Examined for Mutations | Transient Delivery | Expression Cassette | Mutant Reads | Total Reads |
|---|---|---|---|---|
| LIGCas-3 | — | Cas9 | 24.2 | 1,599,492 |
| LIGCas-3 | — | Cas9/guide RNA | 44170 | 1,674,825 |
| LIGCas-3 | 35 ng guide RNA | Cas9 | 418 | 1,622,180 |
| LIGCas-3 | 70 ng guide RNA | Cas9 | 667 | 1,791,388 |
| LIGCas-3 | 140 ng guide RNA | Cas9 | 239 | 1,632,137 |

Increased efficiency (increased mutant reads) may occur when the Cas9 protein and guide RNA are present in the cell at the same time. To facilitate the presence of both Cas9 endonuclease and guide RNA in the same cell, a vector containing a constitutive and conditionally regulated Cas9 gene can be first delivered to plant cells to allow for stable integration into the plant genome to establish a plant line that contains only the Cas9 gene in the plant genome. Then, single or multiple guide RNAs can be delivered as either DNA or RNA, or combination, to the embryo cells of the plant line containing the genome-integrated version of the Cas9 gene.

Transgenic maize (genotype Hi-II) lines with an integrated Cas9 gene driven by either a constitutive (Ubi) or an inducible (CAS) promoter were generated via *Agrobacterium*-mediated transformation. Besides the Cas9 gene, the Agro vector also contained a visible marker (END2:Cyan) and a Red Fluorescent Protein sequence interrupted with a 318 bp long linker (H2B:RF-FP). The linker sequence was flanked with 370 bp long direct repeats to promote recombination and restoration of a functional RFP gene sequence upon double strand break within the linker.

Lines with single copies of the transgene were identified and used for further experiments. Two guide RNA constructs targeting 2 different sites (Table 45 in the linker sequence, were delivered into immature embryo cells via particle bombardment. Meganuclease variant LIG3-4 B65 with very high cutting activity previously used in similar experiments was used as the positive control.

TABLE 45

Target sites in the RF-FP linker for guideRNA/Cas endonuclease system.

| Locus | Guide RNA Used | Target Site Designation | Target Site Sequence | PAM Sequence | SEQ ID NO: |
|---|---|---|---|---|---|
| RF-FP linker | Long | RF-FPCas-1 | GCAGGTCTCACGACGGT | TGG | 535 |
|  | Long | RF-FPCas-2 | GTAAAGTACGCGTACGTGTG | AGG | 536 |

After transformation, embryos with Cas9 gene under Ubiquitin promoter were incubated at 28° C. while embryos with Cas9 gene under temperature inducible CAS promoter were first incubated at 37° C. for 15-20 hours and then transferred to 28° C. Embryos were examined 3-5 days after bombardment under luminescent microscope. Expression and activity of the pre-integrated Cas9 protein was visually evaluated based on the number of embryo cells with RFP protein expression. In most lines, the guide RNA/Cas endonuclease system demonstrated similar or higher frequency of RFP repair than LIG3-4 B65 meganuclease indicating high level of Cas9 protein expression and activity in the generated transgenic lines.

This example describes the production of transgenic lines with a pre-integrated Cas9 gene that can be used in further experiments to evaluate efficiency of mutagenesis at a target site upon transient delivery of guide RNA in the form of RNA molecules.

Example 39

The Guide RNA/Cas Endonuclease System Delivers Double-Strand Breaks to the Maize ALS Locus and Facilitates Editing of the ALS Gene This example demonstrates that the guide RNA/Cas endonuclease system can be efficiently used to introduce specific changes into the nucleotide sequence of the maize ALS gene resulting in resistance to sulfonylurea class herbicides, specifically, chlorsulfuron.

Endogenous ALS protein is the target site of ALS inhibitor sulfonylurea class herbicides. Expression of the herbicide tolerant version of ALS protein in crops confers tolerance to this class of herbicides. The ALS protein contains N-terminal transit peptides, and the mature protein is formed following transport into the chloroplast and subsequent cleavage of the transit peptide. The mature protein starts at residue S41, resulting in a mature protein of 598 amino acids with a predicted molecular weight of 65 kDa (SEQ ID NO: 550).

TABLE 46

Deduced Amino Acid Sequence of the Full-Length ZM-ALS Protein (SEQ ID no: 550)

```
  1 MATAAAASTA LTGATTAAPK ARRRAHLLAT RRALAAPIRC SAASPAMPMA

51 PPATPLRPWG PTEPRKGADI LVESLERCGV RDVFAYPGGA SMEIHQALTR

101 SPVIANHLFR HEQGEAFAAS GYARSSGRVG VCIATSGPGA TNLVSALADA

151 LLDSVPMVAI TGQVPRRMIG TDAFQETPIV EVTRSITKHN YLVLDVDDIP

201 RVVQEAFFLA SSGRPGPVLV DIPKDIQQQM AVPVWDKPMS LPGYIARLPK

251 PPATELLEQV LRLVGESRRP VLYVGGGCAA SGEELRRFVE LTGIPVTTTL

301 MGLGNFPSDD PLSLRMLGMH GTVYANYAVD KADLLLALGV RFDDRVTGKI

351 EAFASRAKIV HVDIDPAEIG KNKQPHVSIC ADVKLALQGM NALLEGSTSK

401 KSFDFGSWND ELDQQKREFP LGYKTSNEEI QPQYAIQVLD ELTKGEAIIG

451 TGVGQHQMWA AQYYTYKRPR QWLSSAGLGA MGFGLPAAAG ASVANPGVTV

501 VDIDGDGSFL MNVQELAMIR IENLPVKVFV LNNQHLGMVV QWEDRFYKAN

551 RAHTYLGNPE NESEIYPDFV TIAKGFNIPA VRVTKKNEVR AAIKKMLETP

601 GPYLLDIIVP HQEHVLPMIP SGGAFKDMIL DGDGRTVY
```

Modification of a single amino acid residue (P165A or P165S, shown in bold) from the endogenous maize acetoacetate synthase protein provides resistance to herbicides in maize.

There are two ALS genes in maize, ALS1 and ALS2, located on chromosomes 5 and 4, respectively. As described in Example 2, guide RNA expressing constructs for 3 different target sites within the ALS genes were tested. Based on polymorphism between ALS1 and ALS2 nucleotide sequences, ALS1-specific and ALSCas-4 target site were identified and tested. ALSCas-1 guide RNA expressing construct targeting both ALS1 and ALS2 genes was used as control (Table 47)

TABLE 47

Maize ALS genomic target sites tested.

| Locus | Location | Guide RNA | Target Site Designation | Maize Genomic Target Site Sequence | PAM Sequence | SEQ ID NO: |
|---|---|---|---|---|---|---|
| ALS | Chr. 4: 107.73cM and Chr. 5: 115.49cM | Long Long | ALSCas-1 ALSCas-4 | GGTGCCAATCATGCGTCG GCTGCTCGATTCCGTCCCCA | CGG TGG* | 22 537 |

*Target site in the ALS1 gene; bolded nucleotides are different in the ALS2 gene.

The experiment was conducted and mutation frequency determined as described in Example 2 and results are shown in Table 48.

TABLE 48

Frequencies of NHEJ mutations at the two ALS target sites recovered by deep sequencing.

| TS | Total Reads | Mutant reads (ALS1) | Mutant reads (ALS2) |
|---|---|---|---|
| ALSCas-1 | 204,230 | 5072 (2.5%) | 2704 (1.3%) |
| ALSCas-4 | 120,766 | 3294 (2.7%) | 40 (0.03%) |

The results demonstrated that ALSCas-4 guide RNA/Cas9 system mutates the ALS1 gene with approximately 90 times higher efficiency than the ALS2 gene. Therefore, the ALSCas-4 target site and the corresponding guide RNA were selected for the ALS gene editing experiment.

To produce edited events, the ALS polynucleotide modification repair template was co-delivered using particle bombardment as a plasmid with an 804 bp long homologous region (SEQ ID NO: 538) or as a single-stranded 127 bp DNA fragment (SEQ ID NO: 539), the maize optimized Cas9 endonuclease expression vector described in Example 1, the guide RNA expression cassette (targeting ALSCas-4 site), a moPAT-DsRed fusion as selectable and visible markers, and developmental genes (ODP-2 and WUS). Approximately 1000 Hi-II immature embryos were bombarded with each of the two repair templates described above. Forty days after bombardment, 600 young callus events (300 for each repair template) were collected and transferred to the media with bialaphos selection. The embryos with remaining events were transferred to the media with 100 ppm of chlorsulfuron for selection. A month later, events that continued growing under chlorsulfuron selection were collected and used for analysis.

A small amount of callus tissue from each selected event was used for total DNA extraction. A pair of genomic primers outside the repair/donor DNA fragment (SEQ ID NO:540 and SEQ ID NO:541) was used to amplify an endogenous fragment of the ALS1 locus containing the ALSCas4 target sequence. The PCR amplification products were gel purified, cloned into the pCR2.1 TOPO cloning vector (Invitrogen) and sequenced. A total of 6 events demonstrated the presence of the specifically edited ALS1 allele as well as either a wild type or a mutagenized second allele.

These data indicate that a guide RNA/Cas system can be successfully used to create edited ALS allele in maize. The data further demonstrates that the guide RNA/maize optimized Cas endonuclease system described herein, can be used to produce progeny plants containing gene edits that are stably inherited.

Example 40

Gene Editing of the Soybean ALS1 Gene and Use as a Transformation Selectable Marker for Soybean Transformation with the Guide RNA/Cas Endonuclease System A. guideRNA/Cas9 Endonuclease Target Site Design on the Soybean ALS1 Gene.

There are four ALS genes in soybean (Glyma04 g37270, Glyma06 g17790, Glyma13 g31470 and Glyma15 g07860). Two guideRNA/Cas9 endonuclease target sites (soy ALS1-CR1 and soy ALS1-CR2) were designed near the Proline 178 of the soybean ALS1 gene Glyma04 g37270 (Table 49).

TABLE 49

Guide RNA/Cas9 endonuclease target sites on soybean ALS1 gene

| Name of gRNA-Cas9 endonuclease target site | Cas endonuclease target sequence (SEQ ID NO:) | Physical location |
|---|---|---|
| soy ALS1-CR1 | 542 | Gm04: 43645633..43645612 |
| soy ALS1-CR2 | 543 | Gm04: 43645594..43645615 |

B. Guide-RNA Expression Cassettes, Cas9 Endonuclease Expression Cassettes, Polynucleotide Modification Templates for Introduction of Specific Amino Acid Changes and Use the P178S Modified ALS1 Allele as a Soybean Transformation Selectable Marker The soybean U6 small nuclear RNA promoter, GM-U6-13.1 (SEQ ID. NO: 469), was used to express guide RNAs to direct Cas9 nuclease to designated genomic target sites (Table 50). A soybean codon optimized Cas9 endonuclease (SEQ ID NO:489) expression cassette and a guide RNA expression cassette were linked in a first plasmid that was co-delivered with a polynucleotide modification template.

The polynucleotide modification template contained specific nucleotide changes that encoded for amino acid changes in the soy ALS1 polypeptide (Glyma04 g37270), such as the P178S. Other amino acid changes in the ALS1 polypeptide can also be obtained using the guide RNA/Cas endonuclease system described herein. Specific amino acid modifications can be achieved by homologous recombination between the genomic DNA and the polynucleotide modification template facilitated by the guideRNA/Cas endonuclease system.

TABLE 50

Guide RNA/Cas9 expression cassettes and polynucleotide modification templates used in soybean stable transformation for the specific amino acid modifications of the soy ALS1 gene.

| Experiment | Guide RNA/Cas9 (plasmid name) | SEQ ID NO: | polynucleotide modification template | SEQ ID NO: |
|---|---|---|---|---|
| soy ALS1-CR1 | U6-13.1:ALS1-CR1 + EF1A2:CAS9 (QC880) | 544 | RTW1026A | 546 |
| soy ALS-CR2 | U6-13.1:ALS1-CR2 + EF1A2:CAS9 (QC881) | 545 | RTW1026A | 546 |

C. Detection of the P178S Mutation in the Soybean ALS1 Gene in the Event Selected by Chlorsulfuron In order to edit specific amino acids at the native ALS1 gene (such as the P178S modification), a polynucleotide modification template such as RTW1026A (Table 50), was co-delivered with the guideRNA/Cas9 expression cassettes into soybean cells. Chlorsulfuron (100 ppb) was used to select the P178S ALS1 gene editing events in soybean transformation process.

The modification of the native ALS1 gene via guide RNA/Cas9 system mediated DNA homologous recombination was determined by specific PCR analysis. A specific PCR assay with primer pair WOL900 (SEQ ID NO: 547) and WOL578 (SEQ ID NO: 548) was used to detect perfect P178S modification at the native ALS1 gene. A second primer pair WOL573 (SEQ ID NO: 549) and WOL578 (SEQ ID NO: 548) was used to amplify both a P178S modified Soy ALS1 allele and a NHEJ mutated allele. A chlorsulfuron tolerant event (MSE3772-18) was generated from the soy ALS1-CR2 experiment. The event contained a perfect P178S modified allele and a $2^{nd}$ allele with a 5 bp deletion at the soyALS1-CR2 cleavage site. Topo cloning/sequencing was used to verify the sequences. Our results demonstrated one P178S modified ALS1 allele is sufficient to provide Chlorsulfuron selection in soybean transformation process.

Example 41

Soybean FAD2-1 Gene Knockout in Combination with P178S ALS1 Modification as a Selectable Marker Using the GuideRNA/Cas Endonuclease System This example describes a method for gene modification in a plant genome using the guide RNA/Cas system without the insertion of an exogenous selectable marker into said plant genome. Instead, an herbicide resistance trait is generated by editing a first gene located in a plant genome while simultaneously knocking out a second gene located at a different locus than the first gene. This is accomplished by using two guides in combination with the Cas endonuclease as described below.

A. guideRNA/Cas9 Endonuclease Target Site Design on the Soybean FAD2-1 Genes.

There are two FAD2-1 genes in soybean (FAD2-1A for Glyma10 g42470 and FAD2-1B for Glyma20 g24530). Two guideRNA/Cas9 endonuclease target sites (soy FAD2-1-CR1 and soy FAD2-1-CR2) were designed to target both FAD2-1 genes for each gRNA (Table 51).

TABLE 51

Guide RNA/Cas9 endonuclease target sites on soybean FAD2-1 gene

| Name of gRNA-Cas9 endonuclease target site | Cas endonuclease target sequence (SEQ ID NO:) | Physical location |
|---|---|---|
| soy FAD2-1-CR1 | 551 | Gm10: 49417140..49417118<br>Gm20: 34178367..34178345 |
| soy FAD2-1-CR2 | 552 | Gm10: 49417140..49417161<br>Gm20: 34178367..34178388 |

B. Guide-RNA Expression Cassettes, Cas9 Endonuclease Expression Cassettes and Knockout of the Soybean FAD2-1 Genes with P178S ALS1 Gene Editing as the Transformation Selectable Marker.

The soybean U6 small nuclear RNA promoter, GM-U6-13.1 (SEQ ID. NO: 469), was used to express guide RNAs to direct Cas9 nuclease to designated genomic target sites (Table 52). A soybean codon optimized Cas9 endonuclease (SEQ ID NO: 489) expression cassette and a guide RNA expression cassette for the ALS1 gene were linked in a first plasmid (QC881) that was co-delivered with an ALS1 polynucleotide modification template (RTW1026A). With a second gRNA plasmid (RTW1211 or RTW1212) targeting the FAD2-1 genes simultaneously, the FAD2-1 knockout events can be identified in the chlorsulfuron tolerant events by qPCR and PCR assays.

TABLE 52

Guide RNA/Cas9 expression cassettes and polynucleotide modification templates used in soybean stable transformation for the specific amino acid modifications of the soy ALS1 gene and FAD2-1 knock-out.

| Experiment | Guide RNA/Cas9 (plasmid name) | SEQ ID NO: | polynucleotide modification template | SEQ ID NO: |
|---|---|---|---|---|
| soy ALS1-CR2 | QC881 | 545 | RTW1026A | 546 |
| soy FAD2-1-CR1 | RTW1211 | 553 | | |
| soy ALS-CR2 | QC881 | 545 | RTW1026A | 546 |
| soy FAD2-1 CR2 | RTW1212 | 554 | | |

Example 42

Soybean EPSPS1 Gene Editing in Combination with P178S ALS1 Modification as a Selectable Marker Using the Guide RNA/Cas Endonuclease System This example describes a method for gene modification in a plant genome using the guide RNA/Cas system without the insertion of an exogenous selectable marker into said plant genome. Instead, an herbicide resistance trait is generated by editing a first gene located in a plant genome while simultaneously inserting a polynucleotide of interest located at a different locus in the plant genome. This is accomplished by using two guides in combination with the Cas endonuclease as described below.

The EPSPS gene editing as described in Example 24, 25 and 26 can also be carried out in combination with the P178S ALS1 modification by using multiple gRNAs targeting both the soybean EPSPS gene and soy ALS1 gene. The soybean EPSPS1 gene editing events can be identified in the chlorsulfuron tolerant events.

Example 43

Targeted Gene Integration in Combination with P178S ALS1 Modification as a Selectable Marker Using the Guide RNA/Cas Endonuclease System This example describes a method for gene modification in a plant genome using the guide RNA/Cas system without the insertion of an exogenous selectable marker into said plant genome. Instead, an herbicide resistance trait is generated by editing a first gene located in a plant genome while simultaneously editing a second gene located at a different locus in the plant genome. This is accomplished by using two guides in combination with the Cas endonuclease as described below.

The targeted gene integration in soybean as described in Example 19, 20 and 21 can also be carried out in combination with the P178S ALS1 modification by using multiple gRNAs targeting both the intended gene integration sites and soy ALS1 gene. The perfect gene integration events can be identified in the chlorsulfuron tolerant events.

SEQUENCE LISTING (571 sequences)

SEQ ID NO: 1 - DNA, 4107 bp, Streptococcus pyogenes
  source 1..4107: mol_type = genomic DNA
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - DNA, 189 bp, Solanum tuberosum
  source 1..189: mol_type = genomic DNA
gtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcag

SEQ ID NO: 3 - protein, 9 aa, Simian virus 40
MAPKKKRKV

SEQ ID NO: 4 - protein, 18 aa, Agrobacterium tumefaciens
KRPRDRHDGELGGRKRAR

SEQ ID NO: 5 - DNA, 6717 bp, synthetic construct
  misc_feature 1..6717: note = synthesized sequence-Maize optimized Cas9 expression cassette
  source 1..6717: mol_type = other DNA
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggcc

SEQ ID NO: 6 - RNA, 39 nt, synthetic construct
  misc_feature 1..39: note = synthesized sequence-crRNA containing the LIGCas-3 target sequence in the variable targeting domain
  source 1..39: mol_type = other RNA
gcgtacgcgtacgtgtggttttagagctatgctgttttg

SEQ ID NO: 7 - RNA, 86 nt, Streptococcus pyogenes
  misc_feature 1..86: note = tracrRNA
  source 1..86: mol_type = genomic RNA
ggaaccattcaaaacagcatagcaagttaaaataaggctagtccgttatcaacttgaaaaagtggcaccgagtcggtgcttttttt

SEQ ID NO: 8 - RNA, 94 nt, synthetic construct
  misc_feature 1..94: note = synthesized sequence- Long guide RNA containing the LIGCas-3 target sequence in the variable targeting domain
  source 1..94: mol_type = other RNA
gcgtacgcgtacgtgtggttttagagctagaaatagcaagttaaaataaggctagtccgttatcaacttgaaaaagtggcaccgagtcggtgct

SEQ ID NO: 9 - DNA, 1000 bp, Zea mays
  source 1..1000: mol_type = genomic DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaatt

SEQ ID NO: 10 - DNA, 16 bp, Zea mays
  source 1..16: mol_type = genomic DNA
tttttttttttttttt

SEQ ID NO: 11 - RNA, 59 nt, synthetic construct
  misc_feature 1..59: note = synthesized sequence- Short guide RNA containing the LIGCas-3 variable targeting domain
  source 1..59: mol_type = other RNA
gcgtacgcgtacgtgtggttttagagctagaaatagcaagttaaaataaggctagtccg

SEQ ID NO: 12 - DNA, 1102 bp, synthetic construct
  misc_feature 1..1102: note = synthesized sequence- Maize optimized long guide RNA expression cassette containing the LIGCas-3 variable targeting domain
  source 1..1102: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcgtacgcgtacgtgtggttttagagctagaaatagcaagttaaaataaggctagtccgttatcaacttgaaaaagtggcaccgagtcggtgcttttttttt

SEQ ID NO: 13 - DNA, 27 bp, Zea mays
  source 1..27: mol_type = genomic DNA
gtactccatccgccccatcgagtaggg

SEQ ID NO: 14 - DNA, 24 bp, Zea mays
  source 1..24: mol_type = genomic DNA
gcacgtacgtcaccatcccgccgg

SEQ ID NO: 15 - DNA, 24 bp, Zea mays
  source 1..24: mol_type = genomic DNA
gacgtacgtgccctactcgatggg

SEQ ID NO: 16 - DNA, 24 bp, Zea mays
  source 1..24: mol_type = genomic DNA
gtaccgtacgtgccccggcggagg

SEQ ID NO: 17 - DNA, 24 bp, Zea mays
  source 1..24: mol_type = genomic DNA
ggaattgtaccgtacgtgccccgg

SEQ ID NO: 18 - DNA, 20 bp, Zea mays
  source 1..20: mol_type = genomic DNA
gcgtacgcgtacgtgtgagg

SEQ ID NO: 19 - DNA, 22 bp, Zea mays
  source 1..22: mol_type = genomic DNA
gctggccgaggtcgactaccgg

SEQ ID NO: 20 - DNA, 23 bp, Zea mays
  source 1..23: mol_type = genomic DNA
ggccgaggtcgactaccggccgg

SEQ ID NO: 21 - DNA, 23 bp, Zea mays
  source 1..23: mol_type = genomic DNA
ggcgcgagctcgtgcttcaccgg

SEQ ID NO: 22 - DNA, 21 bp, Zea mays
  source 1..21: mol_type = genomic DNA
ggtgccaatcatgcgtcgcgg

SEQ ID NO: 23 - DNA, 20 bp, Zea mays
  source 1..20: mol_type = genomic DNA
ggtcgccatcacgggacagg

SEQ ID NO: 24 - DNA, 24 bp, Zea mays
  source 1..24: mol_type = genomic DNA
gtcgcggcacctgtcccgtgatgg

SEQ ID NO: 25 - DNA, 23 bp, Zea mays
  source 1..23: mol_type = genomic DNA
ggaatgctggaactgcaatgcgg

SEQ ID NO: 26 - DNA, 24 bp, Zea mays
  source 1..24: mol_type = genomic DNA
gcagctcttcttggggaatgctgg

SEQ ID NO: 27 - DNA, 23 bp, Zea mays
  source 1..23: mol_type = genomic DNA
gcagtaacagctgctgtcaatgg

SEQ ID NO: 28 - DNA, 56 bp, synthetic construct
  misc_feature 1..56: note = synthesized sequence- MS26Cas-1 forward primer
  source 1..56: mol_type = other DNA
ctacactctttccctacacgacgctcttccgatctaggaccggaagctcgccgcgt

SEQ ID NO: 29 - DNA, 54 bp, synthetic construct
  misc_feature 1..54: note = synthesized sequence- MS26Cas-1 and MS26Cas-3 reverse primer
  source 1..54: mol_type = other DNA
caagcagaagacggcatacgagctcttccgatcttcctggaggacgacgtgctg

SEQ ID NO: 30 - DNA, 59 bp, synthetic construct
  misc_feature 1..59: note = synthesized sequence- MS26Cas-2 forward primer
  source 1..59: mol_type = other DNA
ctacactctttccctacacgacgctcttccgatctaaggtcctggaggacgacgtgctg

SEQ ID NO: 31 - DNA, 51 bp, synthetic construct
  misc_feature 1..51: note = synthesized sequence- MS26Cas-2 and MS26 meganuclease reverse primer
  source 1..51: mol_type = other DNA
caagcagaagacggcatacgagctcttccgatctccggaagctcgccgcgt

SEQ ID NO: 32 - DNA, 56 bp, synthetic construct
  misc_feature 1..56: note = synthesized sequence- MS26Cas-3 forward primer
  source 1..56: mol_type = other DNA
ctacactctttccctacacgacgctcttccgatcttcctccggaagctcgccgcgt

SEQ ID NO: 33 - DNA, 59 bp, synthetic construct
  misc_feature 1..59: note = synthesized sequence- MS26 Meganuclease forward primer
  source 1..59: mol_type = other DNA
ctacactctttccctacacgacgctcttccgatctttcctcctggaggacgacgtgctg

SEQ ID NO: 34 - DNA, 63 bp, synthetic construct
  misc_feature 1..63: note = synthesized sequence- LIGCas-1 forward primer
  source 1..63: mol_type = other DNA
ctacactctttccctacacgacgctcttccgatctaggactgtaacgatttacgcacctgctg

SEQ ID NO: 35 - DNA, 58 bp, synthetic construct
  misc_feature 1..58: note = synthesized sequence- LIGCas-1 and LIGCas-2 reverse primer
  source 1..58: mol_type = other DNA
caagcagaagacggcatacgagctcttccgatctgcaaatgagtagcagcgcacgtat

SEQ ID NO: 36 - DNA, 63 bp, synthetic construct
  misc_feature 1..63: note = synthesized sequence- LIGCas-2 forward primer
  source 1..63: mol_type = other DNA
ctacactctttccctacacgacgctcttccgatcttcctctgtaacgatttacgcacctgctg

SEQ ID NO: 37 - DNA, 60 bp, synthetic construct
  misc_feature 1..60: note = synthesized sequence- LIGCas-3 forward primer
  source 1..60: mol_type = other DNA
ctacactctttccctacacgacgctcttccgatctaaggcgcaaatgagtagcagcgcac

SEQ ID NO: 38 - DNA, 57 bp, synthetic construct
  misc_feature 1..57: note = synthesized sequence- LIGCas-3 and LIG3-4 meganuclease reverse primer
  source 1..57: mol_type = other DNA
caagcagaagacggcatacgagctcttccgatctcacctgctgggaattgtaccgta

SEQ ID NO: 39 - DNA, 60 bp, synthetic construct
  misc_feature 1..60: note = synthesized sequence- LIG3-4 meganuclease forward primer
  source 1..60: mol_type = other DNA
ctacactctttccctacacgacgctcttccgatctccttcgcaaatgagtagcagcgcac

SEQ ID NO: 40 - DNA, 58 bp, synthetic construct
  misc_feature 1..58: note = synthesized sequence- MS45Cas-1 forward primer
  source 1..58: mol_type = other DNA
ctacactctttccctacacgacgctcttccgatctaggaggacccgttcggcctcagt

SEQ ID NO: 41 - DNA, 54 bp, synthetic construct
  misc_feature 1..54: note = synthesized sequence- MS45Cas-1, MS45Cas-2 and MS45Cas-3 reverse primer
  source 1..54: mol_type = other DNA
caagcagaagacggcatacgagctcttccgatctgccggctggcattgtctctg

SEQ ID NO: 42 - DNA, 58 bp, synthetic construct
  misc_feature 1..58: note = synthesized sequence- MS45Cas-2 forward primer
  source 1..58: mol_type = other DNA
ctacactctttccctacacgacgctcttccgatcttcctggacccgttcggcctcagt

SEQ ID NO: 43 - DNA, 58 bp, synthetic construct
  misc_feature 1..58: note = synthesized sequence- MS45Cas-3 forward primer
  source 1..58: mol_type = other DNA
ctacactctttccctacacgacgctcttccgatctgaagggacccgttcggcctcagt

SEQ ID NO: 44 - DNA, 58 bp, synthetic construct
  misc_feature 1..58: note = synthesized sequence- ALSCas-1 forward primer
  source 1..58: mol_type = other DNA
ctacactctttccctacacgacgctcttccgatctaaggcgacgatgggcgtctcctg

SEQ ID NO: 45 - DNA, 53 bp, synthetic construct
  misc_feature 1..53: note = synthesized sequence- ALSCas-1, ALSCas-2 and ALSCas-3 reverse primer
  source 1..53: mol_type = other DNA
caagcagaagacggcatacgagctcttccgatctgcgtctgcatcgccacctc

SEQ ID NO: 46 - DNA, 58 bp, synthetic construct
  misc_feature 1..58: note = synthesized sequence- ALSCas-2 forward primer
  source 1..58: mol_type = other DNA
ctacactctttccctacacgacgctcttccgatctttcccgacgatgggcgtctcctg

SEQ ID NO: 47 - DNA, 58 bp, synthetic construct
  misc_feature 1..58: note = synthesized sequence- ALSCas-3 forward primer
  source 1..58: mol_type = other DNA
ctacactctttccctacacgacgctcttccgatctggaacgacgatgggcgtctcctg

SEQ ID NO: 48 - DNA, 63 bp, synthetic construct
  misc_feature 1..63: note = synthesized sequence- EPSPSCas-1 forward primer
  source 1..63: mol_type = other DNA
ctacactctttccctacacgacgctcttccgatctggaagaggaaacatacgttgcatttcca

SEQ ID NO: 49 - DNA, 57 bp, synthetic construct
  misc_feature 1..57: note = synthesized sequence- PSPSCas-1 and EPSPSCas-3 reverse primer
  source 1..57: mol_type = other DNA
caagcagaagacggcatacgagctcttccgatctggtggaaagttcccagttgagga

SEQ ID NO: 50 - DNA, 62 bp, synthetic construct
  misc_feature 1..62: note = synthesized sequence- PSPSCas-2 forward primer
  source 1..62: mol_type = other DNA
ctacactctttccctacacgacgctcttccgatctaagcggtggaaagttcccagttgagga

SEQ ID NO: 51 - DNA, 58 bp, synthetic construct
  misc_feature 1..58: note = synthesized sequence- EPSPSCas-2 reverse primer
  source 1..58: mol_type = other DNA
caagcagaagacggcatacgagctcttccgatctgaggaaacatacgttgcatttcca

SEQ ID NO: 52 - DNA, 63 bp, synthetic construct
  misc_feature 1..63: note = synthesized sequence- EPSPSCas-3 forward primer
  source 1..63: mol_type = other DNA
ctacactctttccctacacgacgctcttccgatctccttgaggaaacatacgttgcatttcca

SEQ ID NO: 53 - DNA, 43 bp, synthetic construct
  misc_feature 1..43: note = synthesized sequence- Forward primer for secondary PCR
  source 1..43: mol_type = other DNA
aatgatacggcgaccaccgagatctacactctttccctacacg

SEQ ID NO: 54 - DNA, 18 bp, synthetic construct
  misc_feature 1..18: note = synthesized sequence- Reverse primer for secondary PCR
  source 1..18: mol_type = other DNA
caagcagaagacggcata

SEQ ID NO: 55 - DNA, 93 bp, Zea mays
  source 1..93: mol_type = genomic DNA
ctgtaacgatttacgcacctgctgggaattgtaccgtacgtgccccggcggaggatatatatacctcacacgtacgcgtacgcgtatatatac

SEQ ID NO: 56 - DNA, 98 bp, Zea mays
  source 1..98: mol_type = genomic DNA
aggactgtaacgatttacgcacctgctgggaattgtaccgtacgtgccccggtcggaggatatatatacctcacacgtacgcgtacgcgtatatatac

SEQ ID NO: 57 - DNA, 98 bp, Zea mays
  source 1..98: mol_type = genomic DNA
aggactgtaacgatttacgcacctgctgggaattgtaccgtacgtgccccggacggaggatatatatacctcacacgtacgcgtacgcgtatatatac

SEQ ID NO: 58 - DNA, 98 bp, Zea mays
  source 1..98: mol_type = genomic DNA
aggactgtaacgatttacgcacctgctgggaattgtaccgtacgtgccccgggcggaggatatatatacctcacacgtacgcgtacgcgtatatatac

SEQ ID NO: 59 - DNA, 95 bp, Zea mays
  source 1..95: mol_type = genomic DNA
aggactgtaacgatttacgcacctgctgggaattgtaccgtacgtgcggtcggaggatatatatacctcacacgtacgcgtacgcgtatatatac

SEQ ID NO: 60 - DNA, 98 bp, Zea mays
  source 1..98: mol_type = genomic DNA
aggactgtaacgatttacgcacctgctgggaattgtaccgtacgtgccccggccggaggatatatatacctcacacgtacgcgtacgcgtatatatac

SEQ ID NO: 61 - DNA, 96 bp, Zea mays
  source 1..96: mol_type = genomic DNA
aggactgtaacgatttacgcacctgctgggaattgtaccgtacgtgccccgcggaggatatatatacctcacacgtacgcgtacgcgtatatatac

SEQ ID NO: 62 - DNA, 96 bp, Zea mays
  source 1..96: mol_type = genomic DNA
aggactgtaacgatttacgcacctgctgggaattgtaccgtacgtgccccggggaggatatatatacctcacacgtacgcgtacgcgtatatatac

SEQ ID NO: 63 - DNA, 94 bp, Zea mays
  source 1..94: mol_type = genomic DNA
aggactgtaacgatttacgcacctgctgggaattgtaccgtacgtgccccggaggatatatatacctcacacgtacgcgtacgcgtatatatac

SEQ ID NO: 64 - DNA, 94 bp, Zea mays
  source 1..94: mol_type = genomic DNA
aggactgtaacgatttacgcacctgctgggaattgtaccgtacgtgcgtcggaggatatatatacctcacacgtacgcgtacgcgtatatatac

SEQ ID NO: 65 - DNA, 43 bp, Zea mays
  source 1..43: mol_type = genomic DNA
aggactgtaacgatttacgcacctgctgggaattgtaccgtac

SEQ ID NO: 66 - DNA, 98 bp, Zea mays
  source 1..98: mol_type = genomic DNA
tcctctgtaacgatttacgcacctgctgggaattgtaccgtacgtgaccccggcggaggatatatatacctcacacgtacgcgtacgcgtatatatac

SEQ ID NO: 67 - DNA, 96 bp, Zea mays
  source 1..96: mol_type = genomic DNA
tcctctgtaacgatttacgcacctgctgggaattgtaccgtacgtccccggcggaggatatatatacctcacacgtacgcgtacgcgtatatatac

SEQ ID NO: 68 - DNA, 98 bp, Zea mays
  source 1..98: mol_type = genomic DNA
tcctctgtaacgatttacgcacctgctgggaattgtaccgtacgtgtccccggcggaggatatatatacctcacacgtacgcgtacgcgtatatatac

SEQ ID NO: 69 - DNA, 94 bp, Zea mays
  source 1..94: mol_type = genomic DNA
tcctctgtaacgatttacgcacctgctgggaattgtaccgtacccccggcggaggatatatatacctcacacgtacgcgtacgcgtatatatac

SEQ ID NO: 70 - DNA, 93 bp, Zea mays
  source 1..93: mol_type = genomic DNA
tcctctgtaacgatttacgcacctgctgggaattgtaccgtaccccggcggaggatatatatacctcacacgtacgcgtacgcgtatatatac

SEQ ID NO: 71 - DNA, 98 bp, Zea mays
  source 1..98: mol_type = genomic DNA
tcctctgtaacgatttacgcacctgctgggaattgtaccgtacgtggccccggcggaggatatatatacctcacacgtacgcgtacgcgtatatatac

SEQ ID NO: 72 - DNA, 92 bp, Zea mays
  source 1..92: mol_type = genomic DNA
tcctctgtaacgatttacgcacctgctgggaattgtaccgtacccggcggaggatatatatacctcacacgtacgcgtacgcgtatatatac

SEQ ID NO: 73 - DNA, 99 bp, Zea mays
  source 1..99: mol_type = genomic DNA
tcctctgtaacgatttacgcacctgctgggaattgtaccgtacgtgaaccccggcggaggatatatatacctcacacgtacgcgtacgcgtatatatac

SEQ ID NO: 74 - DNA, 61 bp, Zea mays
  source 1..61: mol_type = genomic DNA
tcctctgtaacgatttacgcacctgctgggaattgtaccgtacgtgtacgcgtatatatac

SEQ ID NO: 75 - DNA, 95 bp, Zea mays
  source 1..95: mol_type = genomic DNA
tcctctgtaacgatttacgcacctgctgggaattgtaccgtacgccccggcggaggatatatatacctcacacgtacgcgtacgcgtatatatac

SEQ ID NO: 76 - DNA, 93 bp, Zea mays
  source 1..93: mol_type = genomic DNA
cgcaaatgagtagcagcgcacgtatatatacgcgtacgcgtacgtgtgaggtatatatatcctccgccggggcacgtacggtacaattcccag

SEQ ID NO: 77 - DNA, 98 bp, Zea mays
  source 1..98: mol_type = genomic DNA
aaggcgcaaatgagtagcagcgcacgtatatatacgcgtacgcgtacgttgtgaggtatatatatcctccgccggggcacgtacggtacaattcccag

SEQ ID NO: 78 - DNA, 96 bp, Zea mays
  source 1..96: mol_type = genomic DNA
aaggcgcaaatgagtagcagcgcacgtatatatacgcgtacgcgtacggtgaggtatatatatcctccgccggggcacgtacggtacaattcccag

SEQ ID NO: 79 - DNA, 96 bp, Zea mays
  source 1..96: mol_type = genomic DNA
aaggcgcaaatgagtagcagcgcacgtatatatacgcgtacgcgtactgtgaggtatatatatcctccgccggggcacgtacggtacaattcccag

SEQ ID NO: 80 - DNA, 95 bp, Zea mays
  source 1..95: mol_type = genomic DNA
aaggcgcaaatgagtagcagcgcacgtatatatacgcgtacgcgtacgtgaggtatatatatcctccgccggggcacgtacggtacaattcccag

SEQ ID NO: 81 - DNA, 68 bp, Zea mays
  source 1..68: mol_type = genomic DNA
aaggcgcaaatgagtagcagcgcacgtatatatatcctccgccggggcacgtacggtacaattcccag

SEQ ID NO: 82 - DNA, 55 bp, Zea mays
  source 1..55: mol_type = genomic DNA
aaggcgcaaatgagtagcagcgcacgtatatatacgcgtacggtacaattcccag

SEQ ID NO: 83 - DNA, 93 bp, Zea mays
  source 1..93: mol_type = genomic DNA
aaggcgcaaatgagtagcagcgcacgtatatatacgcgtacgcgtgtgaggtatatatatcctccgccggggcacgtacggtacaattcccag

SEQ ID NO: 84 - DNA, 69 bp, Zea mays
  source 1..69: mol_type = genomic DNA
aaggcgcaaatgagtagcagcgcacgtatatatacgcgtacgccggggcacgtacggtacaattcccag

SEQ ID NO: 85 - DNA, 66 bp, Zea mays
  source 1..66: mol_type = genomic DNA
aaggcgcaaatgagtagcagcgcacgtatatatcctccgccggggcacgtacggtacaattcccag

SEQ ID NO: 86 - DNA, 95 bp, Zea mays
  source 1..95: mol_type = genomic DNA
aaggcgcaaatgagtagcagcgcacgtatatatacgcgtacgcgtatgtgaggtatatatatcctccgccggggcacgtacggtacaattcccag

SEQ ID NO: 87 - DNA, 95 bp, Zea mays
  source 1..95: mol_type = genomic DNA
ccttcgcaaatgagtagcagcgcacgtatatatacgcgtacgcgtacgtgaggtatatatatcctccgccggggcacgtacggtacaattcccag

SEQ ID NO: 88 - DNA, 68 bp, Zea mays
  source 1..68: mol_type = genomic DNA
ccttcgcaaatgagtagcagcgcacgtatatatatcctccgccggggcacgtacggtacaattcccag

SEQ ID NO: 89 - DNA, 65 bp, Zea mays
  source 1..65: mol_type = genomic DNA
ccttcgcaaatgagtagcagcgcacgtatatatacgcgtacgcgtacgtacggtacaattcccag

SEQ ID NO: 90 - DNA, 55 bp, Zea mays
  source 1..55: mol_type = genomic DNA
ccttcgcaaatgagtagcagcgcacgtatatatacgcgtacggtacaattcccag

SEQ ID NO: 91 - DNA, 69 bp, Zea mays
  source 1..69: mol_type = genomic DNA
ccttcgcaaatgagtagcagcgcacgtatatatacgcgtacgccggggcacgtacggtacaattcccag

SEQ ID NO: 92 - DNA, 85 bp, Zea mays
  source 1..85: mol_type = genomic DNA
ccttcgcaaatgagtagcagcgcacgtatatatacgtgtgaggtatatatatcctccgccggggcacgtacggtacaattcccag

SEQ ID NO: 93 - DNA, 93 bp, Zea mays
  source 1..93: mol_type = genomic DNA
ccttcgcaaatgagtagcagcgcacgtatatatacgcgtacgcgtgtgaggtatatatatcctccgccggggcacgtacggtacaattcccag

SEQ ID NO: 94 - DNA, 66 bp, Zea mays
  source 1..66: mol_type = genomic DNA
ccttcgcaaatgagtagcagcgcacgtatatatcctccgccggggcacgtacggtacaattcccag

SEQ ID NO: 95 - DNA, 95 bp, Zea mays
  source 1..95: mol_type = genomic DNA
ccttcgcaaatgagtagcagcgcacgtatatatacgcgtacgcgtacgtgtggtatatatatcctccgccggggcacgtacggtacaattcccag

SEQ ID NO: 96 - DNA, 102 bp, Zea mays
  source 1..102: mol_type = genomic DNA
ccttcgcaaatgagtagcagcgcacgtatatatacgcgtacggtatatatacgtgtgaggtatatatatcctccgccggggcacgtacggtacaattcccag

SEQ ID NO: 97 - DNA, 5424 bp, synthetic construct
  misc_feature 1..5424: note = synthesized sequence- donor DNA -HR Repair DNA
  source 1..5424: mol_type = other DNA
cccatagaaaactgtgtgctataatacaccaaaaggaaagcaaagtgaaaaggaaactttgaatagccaagaagactcggagtgcttcacgccttcacctatcccacataggtgatgagctaagagtaaaatgtagattctctcgagtactgaatattgcctgcacttttccttgcagtaaatacacctttaatccatgacgagagtccactctttgagtccgtcttgagattcttccattgatcatacaacatgacctcgaagtcctgatggagaacaacttatataattaaaactacaatacagaaagttcctgacaattaaaacctttggtggtggcatgccgtaggttaaaaaaaatagataatgacaacacaactggagacacgctctttgccgagtgctcacacgtttgctgagagcgagcactcggcaaatatatgatttgccgaataccaccctcctcggcaaaacaatacactaggcaaaaaggtagtttcccatcaccatgatgcccgccgttaatgtaccttctatgccgagtatgttggcgctcagcaaagagatcgttaccggcgtttgtttcaccaagagctctttgacgagtgtggcacacgacaaaaccttttgccgagtgtaattagtcgtttgccaagtgactggtgcagttggcaaaggagtcgtttattatgtgtgggcaaaatgatatatggtgccagttagggctagcaaattaaaggggggggggggggggttaggttgaagaaggtgacgagtaataaggtctcggacggccgcgcgcatatatatcagatccgatccaatggcacacggtgcaaacgaaaagcacgaaatttccaccagcttaattagggagagaaaaatagagcaccagctgatgagtgaatgaatgagatagacgggacacagagggtccagcaggctagcctactctggccgccctaaatagaagtcagtgccgtgacgacgcgcaaacttcttttgatcggctgcggaaataatatactgtaacgatttacgcacctgctgggaattgtaccgtacgtgccccggcggaggatatatatacctcacacaagggcgaattgtactagttagttagctagtcggtcctagatgccgtaatcattagctaatcgtaagtgacgcttggacacgagcggcttgagctaggaacctacgaagtcatcggaatcagctcaggtgtacagaagttcctatactttctggagaataggaacttcggaataggaacttcgtatacgctagggccgcattcgcaaaacacacctagactagatttgttttgctaacccaattgatattaattatatatgattaatatttatatgtatatggatttggttaatgaaatgcatctggttcatcaaagaattataaagacacgtgacattcatttaggataagaaatatggatgatctctttctcttttattcagataactagtaattacacataacacacaactttgatgcccacattatagtgattagcatgtcactatgtgtgcatccttttatttcatacattaattaagttggccaatccagaagatggacaagtctaggtttcgactcagatctgcgtcaccgggcgcaccgggcgcggcggggccggcagctcgaagtcgcgctgccagaagccgacgtcgtgccagccgccgtgcttgtagccggcggcgcggagggtgccgcgggcggtgtagccgagggcctcgtggaggcgcacggacgggtcgttcgggaggccgatcacggccaccacggacttgaagccctgggcctccatgctcttgaggaggtgggtgtagagggtggagccgaggccgaggcgctggtggcggtgggacacgtacacggtggactccacggtccagtcgtaggcgttgcgggccttccacgggccggcgtaggcgatgccggccaccacgccctccacctcggccacgagccacgggtagcggtcctggaggcgctccaggtcgtcgatccactcctgcggggtctgcggctcggtgcggaagttcacggtggaggtctcgatgtagtggttcacgatgtcgcacacggcggccatgtcggcggcggtggccgggcggatctcgacggggcggcgctcgggggacatggtgtcgtgtggatcccggtggatctgaagttcctatactttctagagaataggaacttcggaataggaacttcgctagcgaattgatcctctagagtcgacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatgcatggaccggaacgccgatctagagaaggtagagaggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccggtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtactatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcaggctagcggcgaattcgcccttgtacgcgtacgcgtatatatacgtgcgctgctactcatttgcgcgggaatacagctcagtctgctgtgcgctgcaggatgtacatacatacatgcgcaggtgcaaagtctacgcgcgcgggcaatgcaagcccctggcgtagttgggccatgactgagatcacgcctcatggtcatggaacgaaacaccgcgtccggccgggctgcccctggcgtcacgcgggaggcagctgctagcgttagcgtacgtacccaccgtctcgtacacaccaccgcagggagagagaagagcgatgcaatgcacatgtacagcatccgcatcatgcatagatactcatatcttcaaggccacacatgcagcagtgtcgtacgctacgttgtttcaacggaggaggaggatacatacatagacacccacagccagcctagcatatagcagatagcatacggactcccgggtgaggaaaaatggagggcgaaccaaaccaaccacaaagaagcagcagcagcagcagcagcagctgcggctgctatcaccactcaccaactccaattaaagatctctctctctctctctactggccggccctgtcagtgccagcgcccggtttgttgctagctgagctgcgggcgtcgctcttagatatagcccaaaactcactccaccaccactcgttccatggaaccctagaccaaaagtactcgcgctctcggccctcgctctcgccctctccctctccgcagcaaaagagatccggccggccgagaagggcgcgcgctagctgcccggctactagctggcgcccgcccgcgcatatatctgtgtcatcgccatcacccacaccatggcccggccggccaacaccgccgtattagctctgtctgtcgctcgtccacctgcgaccgactgagcgatcgatctccaccgagctctccgctaagcgctgtccttgccgccgtcctcccctccgtcccctacgcatccatttccgtgtgctcgtgtgtgcgcgcgcgggcactcctgctcctgctccctccggcccctcctcccctcccaggctcccagctagccgcgcccgcccgcgcgacctgcacctgcacagatcgggcggccgggccgaccgatcgatcgagat

SEQ ID NO: 98 - DNA, 24 bp, synthetic construct
  misc_feature 1..24: note = synthesized sequence- Forward PCR primer
  source 1..24: mol_type = other DNA
cccgttattgtatgaggtaatgac

SEQ ID NO: 99 - DNA, 31 bp, synthetic construct
  misc_feature 1..31: note = synthesized sequence- Reverse PCR primer for site-specific transgene insertion at junction 1
  source 1..31: mol_type = other DNA
gctcgtgtccaagcgtcacttacgattagct

SEQ ID NO: 100 - DNA, 32 bp, synthetic construct
  misc_feature 1..32: note = synthesized sequence- Forward PCR primer for site-specific transgene insertion at junction 2
  source 1..32: mol_type = other DNA
ccatgtctaactgttcatttatatgattctct

SEQ ID NO: 101 - DNA, 24 bp, synthetic construct
  misc_feature 1..24: note = synthesized sequence- Reverse PCR primer for site-specific transgene insertion at junction 2
  source 1..24: mol_type = other DNA
gcagccgataggttcatcatcttc

SEQ ID NO: 102 - DNA, 7850 bp, synthetic construct
  misc_feature 1..7850: note = synthesized sequence- Linked Cas9 and LIGCas-3 long guide RNA expression cassettes
  source 1..7850: mol_type = other DNA
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccccccctcgaggtcgacggtatcgataagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcgtacgcgtacgtgtggttttagagctagaaatagcaagttaaaataaggctagtccgttatcaacttgaaaaagtggcaccgagtcggtgcttttttttt

SEQ ID NO: 103 - DNA, 23 bp, Zea mays
  source 1..23: mol_type = genomic DNA
tgggcaggtctcacgacggttgg

SEQ ID NO: 104 - DNA, 91 bp, Zea mays
  source 1..91: mol_type = genomic DNA
ccggtttcgcgtgctctggctttacattacatgggcaggtctcacgacggttgggctggagagccggctggtaggggaggacctcaacggc

SEQ ID NO: 105 - DNA, 90 bp, Zea mays
  source 1..90: mol_type = genomic DNA
ccggtttcgcgtgctctggctttacattacatgggcaggtctcacgaggttgggctggagagccggctggtaggggaggacctcaacggc

SEQ ID NO: 106 - DNA, 90 bp, Zea mays
  source 1..90: mol_type = genomic DNA
ccggtttcgcgtgctctggctttacattacatgggcaggtctcacacggttgggctggagagccggctggtaggggaggacctcaacggc

SEQ ID NO: 107 - DNA, 92 bp, Zea mays
  source 1..92: mol_type = genomic DNA
ccggtttcgcgtgctctggctttacattacatgggcaggtctcacgacggtttgggctggagagccggctggtaggggaggacctcaacggc

SEQ ID NO: 108 - DNA, 89 bp, Zea mays
  source 1..89: mol_type = genomic DNA
ccggtttcgcgtgctctggctttacattgcatgagcaggtcgtgacggttgggctggagagccggctggtaggggaggacctcaacggc

SEQ ID NO: 109 - DNA, 57 bp, Zea mays
  source 1..57: mol_type = genomic DNA
gggcaggtctcgacggttgggctggagagccggctggtaggggaggacctcaacggc

SEQ ID NO: 110 - DNA, 57 bp, Zea mays
  source 1..57: mol_type = genomic DNA
ccggtttcgcgtgctcttgggctggagagccggctggtaggggaggacctcaacggc

SEQ ID NO: 111 - DNA, 22 bp, Zea mays
  source 1..22: mol_type = genomic DNA
atatacctcacacgtacgcgta

SEQ ID NO: 112 - DNA, 1053 bp, Zea mays
  source 1..1053: mol_type = genomic DNA
atgaacaccaagtacaacaaggagttcctgctctacctggccggcttcgtggacggcgacggctccatcaaggcgcagatcaagccgaaccagtcctgcaagttcaagcaccagctctccctgaccttccaggtgacccagaagacgcagaggcgctggttcctcgacaagctggtcgacgagatcggggtgggctacgtctacgaccgcgggtcggtgtccgactacgagctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcccaggatccgtgggaggtctatcgccatctcaggcatccagcgccgcatcctcggcttcctcaagcccgggttcagggatctccgaagcactcagagctggagcaactaagtccaaggaattcctgctctacctggccggcttcgtggacggcgacggctccatcatcgcgtccatcaagccgcgccagtgctacaagttcaagcacgagctccgcctggagttcaccgtgacccagaagacgcagaggcgctggttcctcgacaagctggtcgacgagatcggggtgggctacgtctacgaccgcgggtcggtgtccgactaccgcctctcccagatcaagcccctgcacaacttcctcacccagctccagccgttcctcaagctgaagcagaagcaggcgaacctcgtcctgaagatcatcgagcagctcccctcggccaaggagtccccggacaagttcctggaggtgtgcacgtgggtcgaccagatcgcggccctcaacgacagcaagacccgcaagacgacctcggagacggtgcgggcggtcctggactccctcagcgagaagaagaagtcgtccccctga

SEQ ID NO: 113 - DNA, 22 bp, Zea mays
  source 1..22: mol_type = genomic DNA
gatggtgacgtacgtgccctac

SEQ ID NO: 114 - DNA, 1053 bp, Zea mays
  source 1..1053: mol_type = genomic DNA
atgaacaccaagtacaacaaggagttcctcctctacctggcaggtttcgtggacggcgatgggtctatcatcgcccagattaccccgcaacagtcctacaagttcaagcacgccctgcggctgaggttcacggtcactcagaagacgcagcgcaggtggttcctcgataagctggtcgacgaaatcggagtcggcaaggtgcgggacaggggctctgtcagcgactacatcctctcccagaagaagccgctccacaacttcctgacccagctgcagcccttcctcaagctcaagcagaagcaggccaacctggtgctcaagatcatcgagcagctgccatctgccaaggagtcaccagacaagttccttgaggtctgcacctgggtcgatcagatcgctgccctgaacgactccaagacgaggaagaccacctccgagaccgtcagggctgtgctggactcactcccaggatccgttggcggtctcagcccttctcaggctagctcggctgcttcctcagccagcagctcacctggctccggtatcagcgaggctctcagagcaggtgccaccaagtccaaggagttcctcctgtacctggcaggcttcgttgacggcgacggctcgatcatggcgtccattaccccgaaccagtcgtgtaagttcaagcatcagctgcgcctgcgctttaccgtcacgcagaagacccagaggcgctggttcctggacaaactggtggacgagatcggggtcgggaaggtgtacgacagagggagcgttagcgactaccggctgtcccagaagaagccgctccacaacttcctgacgcagctccaacccttcctgaagctgaagcagaagcaggcgaaccttgtgctgaagatcattgagcagctgccgagcgccaaggagagccctgacaagttcctggaggtctgcacctgggtcgaccagatcgctgccctcaacgactccaagaccaggaagaccacgagcgagaccgttcgggctgtcctggacagcctctccgagaagaagaagtcgagcccgtag

SEQ ID NO: 115 - DNA, 4104 bp, synthetic construct
  misc_feature 1..4104: note = synthesized sequence- soybean codon optimized Cas9
  source 1..4104: mol_type = other DNA
atggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgac

SEQ ID NO: 116 - DNA, 1503 bp, Glycine max
  source 1..1503: mol_type = genomic DNA
ccgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatc

SEQ ID NO: 117 - DNA, 33 bp, synthetic construct
  misc_feature 1..33: note = synthesized sequence- inker SV40 NLS
  source 1..33: mol_type = other DNA
tctagagccgatcccaagaagaagagaaaggtg

SEQ ID NO: 118 - protein, 1379 aa, synthetic construct
  REGION 1..1379: note = synthesized sequence- Cas9 with a SV40 NLS
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 119 - DNA, 8519 bp, synthetic construct
  misc_feature 1..8519: note = synthesized sequence- QC782
  source 1..8519: mol_type = other DNA
ccgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgctcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccggtac

SEQ ID NO: 120 - DNA, 434 bp, Glycine max
  source 1..434: mol_type = genomic DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaa

SEQ ID NO: 121 - DNA, 104 bp, synthetic construct
  misc_feature 1..104: note = synthesized sequence- Guide RNA for DD43CR1
  source 1..104: mol_type = other DNA
gtcccttgtacttgtacgtagttttagagctagaaatagcaagttaaaataaggctagtccgttatcaacttgaaaaagtggcaccgagtcggtgctttttttt

SEQ ID NO: 122 - DNA, 3098 bp, synthetic construct
  misc_feature 1..3098: note = synthesized sequence- QC783
  source 1..3098: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtcccttgtacttgtacgtagttttagagctagaaatagcaagttaaaataaggctagtccgttatcaacttgaaaaagtggcaccgagtcggtgcttttttttgcggccgctcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccggtac

SEQ ID NO: 123 - DNA, 9093 bp, synthetic construct
  misc_feature 1..9093: note = synthesized sequence- QC815
  source 1..9093: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtcccttgtacttgtacgtagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccggtac

SEQ ID NO: 124 - DNA, 4107 bp, Streptococcus pyogenes
  source 1..4107: mol_type = genomic DNA
atggataagaaatactcaataggcttagatatcggcacaaatagcgtcggatgggcggtgatcactgatgattataaggttccgtctaaaaagctcaagggtctgggaaatacagaccgccacggtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagtggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtagagtagatgctaaagcgattctttctgcacgattgagtaaatcaagacgattagaaaatctcattgctcagctccccggtgagaagaaaaatggattgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctactttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggcgaaactaaatcgtgaagatttgctgcgcaagcaacggacctttgacaacggctctattccctatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaagtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaacgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgtgagcgtatgaaacgtattgaagaaggaataaaagaactaggaagtgatattctaaaggagtatcctgttgaaaacactcaattacaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacaaaagctgaacgtggaggtttgagtgaacttgataaagttggttttatcaaacgccaattggttgaaactcgccaaatcactaagcatgtggcacaaattttggatagtcgcatgaatactaaatacgatgaaaatgataaacttattcgagaggttagagtgattaccttaaaatctaaattagtttctgacttccgaaaagatttccaattctataaagtacgtgagattaacaattaccatcatgcccatgatgcgtatcttaatgccgtcgttggaactgctttgattaagaaatatccaaaacttgaatcggagtttgtctatggtgattataaagtttatgatgttcgtaaaatgattgctaagtctgagcaggaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaataatggaaagaagctcttttgaaaaagatccgattgactttttagaagctaaaggatataaggaagttagaaaagacttaatcattaaactacctaaatatagtctttttgagttagaaaacggtcgtaaacggatgctggctagtgccggagaattgcaaaaaggaaatgagctagctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 125 - DNA, 20 bp, Glycine max
  source 1..20: mol_type = genomic DNA
ggaactgacacacgacatga

SEQ ID NO: 126 - DNA, 20 bp, Glycine max
  source 1..20: mol_type = genomic DNA
gacatgatggaacgtgacta

SEQ ID NO: 127 - DNA, 20 bp, Glycine max
  source 1..20: mol_type = genomic DNA
gtcccttgtacttgtacgta

SEQ ID NO: 128 - DNA, 20 bp, Glycine max
  source 1..20: mol_type = genomic DNA
gtattctagaaaagaggaat

SEQ ID NO: 129 - DNA, 70 bp, Glycine max
  source 1..70: mol_type = genomic DNA
atcaaaattcggaactgacacacgacatgatggaacgtgactaaggtgggtttttgactttgcatgtcga

SEQ ID NO: 130 - DNA, 70 bp, Glycine max
  source 1..70: mol_type = genomic DNA
tcgacatgcaaagtcaaaaacccaccttagtcacgttccatcatgtcgtgtgtcagttccgaattttgat

SEQ ID NO: 131 - DNA, 70 bp, Glycine max
  source 1..70: mol_type = genomic DNA
ggcagactccaattcctcttttctagaataccctccgtacgtacaagtacaagggacttgtgagttgtaa

SEQ ID NO: 132 - DNA, 70 bp, Glycine max
  source 1..70: mol_type = genomic DNA
ttacaactcacaagtcccttgtacttgtacgtacggagggtattctagaaaagaggaattggagtctgcc

SEQ ID NO: 133 - DNA, 71 bp, synthetic construct
  misc_feature 1..71: note = synthesized sequence-primer DD20-S3
  source 1..71: mol_type = other DNA
ctacactctttccctacacgacgctcttccgatctggaatttacagcacaagtagatcacttgtacttatc

SEQ ID NO: 134 - DNA, 59 bp, synthetic construct
  misc_feature 1..59: note = synthesized sequence-primer DD20-A
  source 1..59: mol_type = other DNA
caagcagaagacggcatacgagctcttccgatctaaatcactctcacttcgacatgcaa

SEQ ID NO: 135 - DNA, 71 bp, synthetic construct
  misc_feature 1..71: note = synthesized sequence-primer DD20-S4
  source 1..71: mol_type = other DNA
ctacactctttccctacacgacgctcttccgatctttcctttacagcacaagtagatcacttgtacttatc

SEQ ID NO: 136 - DNA, 68 bp, synthetic construct
  misc_feature 1..68: note = synthesized sequence-primer DD43-S3
  source 1..68: mol_type = other DNA
ctacactctttccctacacgacgctcttccgatctagctgtaaatacagccttacaactcacaagtcc

SEQ ID NO: 137 - DNA, 63 bp, synthetic construct
  misc_feature 1..63: note = synthesized sequence-Primer, DD43-A
  source 1..63: mol_type = other DNA
caagcagaagacggcatacgagctcttccgatctttaatttaggactaaaagaagaggcagac

SEQ ID NO: 138 - DNA, 68 bp, synthetic construct
  misc_feature 1..68: note = synthesized sequence- Primer, DD43-S4
  source 1..68: mol_type = other DNA
ctacactctttccctacacgacgctcttccgatctctaggtaaatacagccttacaactcacaagtcc

SEQ ID NO: 139 - DNA, 68 bp, synthetic construct
  misc_feature 1..68: note = synthesized sequence- Primer, DD43-S5
  source 1..68: mol_type = other DNA
ctacactctttccctacacgacgctcttccgatctgatcgtaaatacagccttacaactcacaagtcc

SEQ ID NO: 140 - DNA, 43 bp, synthetic construct; identical to SEQ ID NO: 53
  misc_feature 1..43: note = synthesized sequence- Primer, JKY557
  source 1..43: mol_type = other DNA

SEQ ID NO: 141 - DNA, 18 bp, synthetic construct
  misc_feature 1..18: note = synthesized sequence- primer, JKY558
  source 1..18: mol_type = other DNA
caagcagaagacggcata

SEQ ID NO: 142 - DNA, 117 bp, synthetic construct
  misc_feature 1..117: note = synthesized sequence- DD20CR1 PCR amplicon
  source 1..117: mol_type = other DNA
ggaatttacagcacaagtagatcacttgtacttatcaaaattcggaactgacacacgacatgatggaacgtgactaaggtgggtttttgactttgcatgtcgaagtgagagtgattt

SEQ ID NO: 143 - DNA, 117 bp, synthetic construct
  misc_feature 1..117: note = synthesized sequence- DD20CR2 PCR amplicon
  source 1..117: mol_type = other DNA
ttcctttacagcacaagtagatcacttgtacttatcaaaattcggaactgacacacgacatgatggaacgtgactaaggtgggtttttgactttgcatgtcgaagtgagagtgattt

SEQ ID NO: 144 - DNA, 108 bp, synthetic construct
  misc_feature 1..108: note = synthesized sequence- DD43CR1 PCR amplicon
  source 1..108: mol_type = other DNA
agctgtaaatacagccttacaactcacaagtcccttgtacttgtacgtacggagggtattctagaaaagaggaattggagtctgcctcttcttttagtcctaaattaa

SEQ ID NO: 145 - DNA, 108 bp, synthetic construct
  misc_feature 1..108: note = synthesized sequence- DD43CR2 PCR amplicon
  source 1..108: mol_type = other DNA
ctaggtaaatacagccttacaactcacaagtcccttgtacttgtacgtacggagggtattctagaaaagaggaattggagtctgcctcttcttttagtcctaaattaa

SEQ ID NO: 146 - DNA, 108 bp, synthetic construct; identical to SEQ ID NO: 145
  misc_feature 1..108: note = synthesized sequence- amplicon
  source 1..108: mol_type = other DNA

SEQ ID NO: 147 - DNA, 101 bp, Glycine max
  source 1..101: mol_type = genomic DNA
ggaatttacagcacaagtagatcacttgtacttatcaaaattcggaactgacacacgatgatggaacgtgactaaggtgggtttttgactttgcatgtcga

SEQ ID NO: 148 - DNA, 101 bp, Glycine max
  source 1..101: mol_type = genomic DNA
ggaatttacagcacaagtagatcacttgtacttatcaaaattcggaactgacacacgatggaacgtgactaaggtgggtttttgactttgcatgtcgaagt

SEQ ID NO: 149 - DNA, 101 bp, Glycine max
  source 1..101: mol_type = genomic DNA
ggaatttacagcacaagtagatcacttgtacttatcaaaattcggaactgacacacgactgatggaacgtgactaaggtgggtttttgactttgcatgtcg

SEQ ID NO: 150 - DNA, 101 bp, Glycine max
  source 1..101: mol_type = genomic DNA
ggaatttacagcacaagtagatcacttgtacttatcaaaattcggaactgacacacatggaacgtgactaaggtgggtttttgactttgcatgtcgaagtg

SEQ ID NO: 151 - DNA, 101 bp, Glycine max
  source 1..101: mol_type = genomic DNA
ggaatttacagcacaagtagatcacttgtacttatcaaaattcggaactgacacatgatggaacgtgactaaggtgggtttttgactttgcatgtcgaagt

SEQ ID NO: 152 - DNA, 101 bp, Glycine max
  source 1..101: mol_type = genomic DNA
ggaatttacagcacaagtagatcacttgtacttatcaaaattcggaactgacacagacatgatggaacgtgactaaggtgggtttttgactttgcatgtcg

SEQ ID NO: 153 - DNA, 101 bp, Glycine max
  source 1..101: mol_type = genomic DNA
ggaatttacagcacaagtagatcacttgtacttatcaaaattcggaactgacacgacatgatggaacgtgactaaggtgggtttttgactttgcatgtcga

SEQ ID NO: 154 - DNA, 101 bp, Glycine max
  source 1..101: mol_type = genomic DNA
ggaatttacagcacaagtagatcacttgtacttatcaaaattcggaactgacacaagaaatgatggaacgtgactaaggtgggtttttgactttgcatgtc

SEQ ID NO: 155 - DNA, 101 bp, Glycine max
  source 1..101: mol_type = genomic DNA
ggaatttacagcacaagtagatcacttgtacttatcaaaattcggaactgacacacgattgaacgtgactaaggtgggtttttgactttgcatgtcgaagt

SEQ ID NO: 156 - DNA, 101 bp, Glycine max
  source 1..101: mol_type = genomic DNA
ggaatttacagcacaagtagatcacttgtacttatcaaaattcggaactgacacacattgaacgtgactaaggtgggtttttgactttgcatgtcgaagtg

SEQ ID NO: 157 - DNA, 101 bp, Glycine max
  source 1..101: mol_type = genomic DNA
ttcctttacagcacaagtagatcacttgtacttatcaaaattcggaactgacacacgacatgatggaacgtctaaggtgggtttttgactttgcatgtcga

SEQ ID NO: 158 - DNA, 101 bp, Glycine max
  source 1..101: mol_type = genomic DNA
ttcctttacagcacaagtagatcacttgtacttatcaaaattcggaactgacacacgacatgatggaacctaaggtgggtttttgactttgcatgtcgaag

SEQ ID NO: 159 - DNA, 101 bp, Glycine max
  source 1..101: mol_type = genomic DNA
ttcctttacagcacaagtagatcacttgtacttatcaaaattcggaactgacacacgacatgatggaacgtgactaggtgggtttttgactttgcatgtcg

SEQ ID NO: 160 - DNA, 101 bp, Glycine max
  source 1..101: mol_type = genomic DNA
ttcctttacagcacaagtagatcacttgtacttatcaaaattcggaactgacacacgacatgatggaactaaggtgggtttttgactttgcatgtcgaagt

SEQ ID NO: 161 - DNA, 101 bp, Glycine max
  source 1..101: mol_type = genomic DNA
ttcctttacagcacaagtagatcacttgtacttatcaaaattcggaactgacacacgacatgatggaacgaaggtgggtttttgactttgcatgtcgaagt

SEQ ID NO: 162 - DNA, 101 bp, Glycine max
  source 1..101: mol_type = genomic DNA
ttcctttacagcacaagtagatcacttgtacttatcaaaattcggaactgacacacgacatgatggaaggtgggtttttgactttgcatgtcgaagtgaga

SEQ ID NO: 163 - DNA, 101 bp, Glycine max
  source 1..101: mol_type = genomic DNA
ttcctttacagcacaagtagatcacttgtacttatcaaaattcggaactgacacacgacatgatggacgtgactaaggtgggtttttgactttgcatgtcg

SEQ ID NO: 164 - DNA, 101 bp, Glycine max
  source 1..101: mol_type = genomic DNA
ttcctttacagcacaagtagatcacttgtacttatcaaaattcggaactgacacacgacatgatggaactttactaaggtgggtttttgactttgcatgtc

SEQ ID NO: 165 - DNA, 101 bp, Glycine max
  source 1..101: mol_type = genomic DNA
ttcctttacagcacaagtagatcacttgtacttatcaaaattcggaactgacacacgacatgatggaacgtgacaaggtgggtttttgactttgcatgtcg

SEQ ID NO: 166 - DNA, 101 bp, Glycine max
  source 1..101: mol_type = genomic DNA
ttcctttacagcacaagtagatcacttgtacttatcaaaattcggaactgacacactacattatttaactttactaaggtgggtttttgactttgcatgtc

SEQ ID NO: 167 - DNA, 108 bp, Glycine max; identical to SEQ ID NO: 144
  source 1..108: mol_type = genomic DNA

SEQ ID NO: 168 - DNA, 101 bp, Glycine max
  source 1..101: mol_type = genomic DNA
agctgtaaatacagccttacaactcacaagtcccttgtacggagggtattctagaaaagaggaattggagtctgcctcttcttttagtcctaaattaaaga

SEQ ID NO: 169 - DNA, 101 bp, Glycine max
  source 1..101: mol_type = genomic DNA
agctgtaaatacagccttacaactcacaagtcccttgtacttgtacggagggtattctagaaaagaggaattggagtctgcctcttcttttagtcctaaat

SEQ ID NO: 170 - DNA, 101 bp, Glycine max
  source 1..101: mol_type = genomic DNA
agctgtaaatacagccttacaactcacaagtcccttacggagggtattctagaaaagaggaattggagtctgcctcttcttttagtcctaaattaaagatc

SEQ ID NO: 171 - DNA, 101 bp, Glycine max
  source 1..101: mol_type = genomic DNA
agctgtaaatacagccttacaactcacaagtcccttgtacttgtaccgtacggagggtattctagaaaagaggaattggagtctgcctcttcttttagtcc

SEQ ID NO: 172 - DNA, 101 bp, Glycine max
  source 1..101: mol_type = genomic DNA
agctgtaaatacagccttacaactcacaagtcccttgtactgtacggagggtattctagaaaagaggaattggagtctgcctcttcttttagtcctaaatt

SEQ ID NO: 173 - DNA, 101 bp, Glycine max
  source 1..101: mol_type = genomic DNA
agctgtaaatacagccttacaactcacaagtcccttgtagtacggagggtattctagaaaagaggaattggagtctgcctcttcttttagtcctaaattaa

SEQ ID NO: 174 - DNA, 101 bp, Glycine max
  source 1..101: mol_type = genomic DNA
agctgtaaatacagccttacaactcacaagtcccttgtacttgtacgtagggtattctagaaaagaggaattggagtctgcctcttcttttagtcctaaat

SEQ ID NO: 175 - DNA, 100 bp, Glycine max
  source 1..100: mol_type = genomic DNA
agctgtaaatacagccttacaactcacaagtcctacactctttccctacacgacgctcttcttttagtcctaaattaaagatcggaagatctcgtatgcc

SEQ ID NO: 176 - DNA, 101 bp, Glycine max
  source 1..101: mol_type = genomic DNA
agctgtaaatacagccttacaactcacaagtcccttgtacttgtaccttacggagggtattctagaaaagaggaattggagtctgcctcttcttttagtcc

SEQ ID NO: 177 - DNA, 101 bp, Glycine max
  source 1..101: mol_type = genomic DNA
ctaggtaaatacagccttacaactcacaagtcccttgtacttgtacgtacggagggtattctagaaaattggagtctgcctcttcttttagtcctaaatta

SEQ ID NO: 178 - DNA, 101 bp, Glycine max
  source 1..101: mol_type = genomic DNA
ctaggtaaatacagccttacaactcacaagtcccttgtacttgtacgtacggagggtattctagaaaagaattggagtctgcctcttcttttagtcctaaa

SEQ ID NO: 179 - DNA, 101 bp, Glycine max
  source 1..101: mol_type = genomic DNA
ctaggtaaatacagccttacaactcacaagtcccttgtacttgtacgtacggagggtattctagaattggagtctgcctcttcttttagtcctaaattaaa

SEQ ID NO: 180 - DNA, 101 bp, Glycine max
  source 1..101: mol_type = genomic DNA
ctaggtaaatacagccttacaactcacaagtcccttgtacttgtacgtacggagggtattctagaaaagaaattggagtctgcctcttcttttagtcctaa

SEQ ID NO: 181 - DNA, 101 bp, Glycine max
  source 1..101: mol_type = genomic DNA
ctaggtaaatacagccttacaactcacaagtcccttgtacttgtacgtacggagggtattctagaaaaattggagtctgcctcttcttttagtcctaaatt

SEQ ID NO: 182 - DNA, 101 bp, Glycine max
  source 1..101: mol_type = genomic DNA
ctaggtaaatacagccttacaactcacaagtcccttgtacttgtacgtacggagggtattctagaaaagaggattggagtctgcctcttcttttagtccta

SEQ ID NO: 183 - DNA, 101 bp, Glycine max
  source 1..101: mol_type = genomic DNA
ctaggtaaatacagccttacaactcacaagtcccttgtacttgtacgtacggagggtattctagaaattggagtctgcctcttcttttagtcctaaattaa

SEQ ID NO: 184 - DNA, 101 bp, Glycine max
  source 1..101: mol_type = genomic DNA
ctaggtaaatacagccttacaactcacaagtcccttgtacttgtacgtacggagggtattctattggagtctgcctcttcttttagtcctaaattaaagat

SEQ ID NO: 185 - DNA, 101 bp, Glycine max
  source 1..101: mol_type = genomic DNA
ctaggtaaatacagccttacaactcacaagtcccttgtacttgtacgtacggagggtattctagtctgcctcttcttttagtcctaaattaaagatcggaa

SEQ ID NO: 186 - DNA, 101 bp, Glycine max
  source 1..101: mol_type = genomic DNA
ctaggtaaatacagccttacaactcacaagtcccttgtacttgtacgtacggagggtattctagaaaagtctgcctcttcttttagtcctaaattaaagat

SEQ ID NO: 187 - DNA, 101 bp, Glycine max
  source 1..101: mol_type = genomic DNA
ctaggtaaatacagccttacaactcacaagtcccttgtacttgtacgtacggagggtattctagaaaagagaattggagtctgcctcttcttttagtccta

SEQ ID NO: 188 - DNA, 101 bp, Glycine max
  source 1..101: mol_type = genomic DNA
ctaggtaaatacagccttacaactcacaagtcccttgtacttgtacgtacggagggtattctagaaaagaggagtctgcctcttcttttagtcctaaatta

SEQ ID NO: 189 - DNA, 101 bp, Glycine max
  source 1..101: mol_type = genomic DNA
ctaggtaaatacagccttacaactcacaagtcccttgtacttgtacgtacggagggtattctaattggagtctgcctcttcttttagtcctaaattaaaga

SEQ ID NO: 190 - DNA, 101 bp, Glycine max
  source 1..101: mol_type = genomic DNA
ctaggtaaatacagccttacaactcacaagtcccttgtacttgtacgtacggagggtattctagaaaagaggaaattggagtctgcctcttcttttagtcc

SEQ ID NO: 191 - DNA, 101 bp, Glycine max
  source 1..101: mol_type = genomic DNA
ctaggtaaatacagccttacaactcacaagtcccttgtacttgtacgtacggagggtattctagaaagaggaattggagtctgcctcttcttttagtccta

SEQ ID NO: 192 - protein, 1377 aa, synthetic construct
  REGION 1..1377: note = synthesized sequence- maize optimized moCAS9 endonuclease
MAPKKKRKVMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 193 - DNA, 6677 bp, synthetic construct
  misc_feature 1..6677: note = synthesized sequence- maize optimized moCAS9 endonuclease
  source 1..6677: mol_type = other DNA
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccccatggccccgaagaagaagaggaaggtgcacatggataagaagtacagcatcggcctcgacatcgggaccaacagcgtcggctgggccgtcatcaccgacgaatataaggtgcccagcaagaagttcaaggtgctcgggaatacagaccgccacagcatcaagaagaacctgatcggcgccctcctgttcgactcgggcgagaccgctgaggccaccagactaaagaggaccgctcgccgccgctacacccgccgcaagaaccgcatatgctacctccaggagatcttcagcaacgagatggccaaggtggacgacagcttcttccaccgccttgaggagtcgttcctcgtggaggaggacaagaagcatgagaggcacccgatcttcgggaacatcgtggacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcgtaccacgagaagtacccgacgatctaccacctccgcaagaagctggtcgactccacagacaaggccgacctcagactgatctacctggccctcgcgcacatgatcaagttccgcgggcacttcctcatcgagggcgacctgaacccggacaactccgacgtcgacaagctcttcatccagctggtccagacctacaatcaactgttcgaggagaacccgatcaacgcgtccggcgtggacgcgaaggccatcctcagcgcgaggctcagcaaatcaagacggctggagaacctgatcgcccagctcccaggcgagaagaaaaacggcttgttcggcaacctgatcgcgctctcgctcggcctcacgcccaacttcaaatcaaacttcgacctggccgaggacgcgaaactgcagctgtccaaggacacttacgacgacgacctcgacaacctgctggcgcaaatcggtgaccagtacgcagacctcttcctggccgccaagaacctctcggacgccatcctgctgtccgatatcctgagagtgaatacggagatcaccaaggcgccgctcagcgcctccatgattaaaaggtacgacgagcaccaccaggacctgacgctgctcaaggccctggtgcgccagcagctccccgagaagtacaaggagatcttcttcgaccaatcaaaaaacggctacgccggctacatcgacgggggcgcctcccaggaggagttctacaagttcatcaaaccaattctcgagaagatggacggcacggaggagcttctcgtgaagctcaaccgggaggacctcctgaggaagcagaggacgttcgacaacggctcgataccgcatcagatccacctgggcgagctccacgccatcctgcgccggcaggaggatttctatccgttcctcaaggacaacagggagaagatcgagaaaattctgacgttccgcatcccgtactacgtgggccctctcgcgcgcgggaacagccggttcgcctggatgactcggaagtcggaggagacgatcacgccgtggaacttcgaggaggtggtggacaagggcgcctccgcccagtcgttcatcgagcgcatgacgaacttcgataaaaatctgcccaatgaaaaagtgctcccgaagcacagcctcctctacgagtacttcacggtgtacaacgagctcacgaaggtgaagtacgtgaccgagggtatgcggaagccggcgttcctgagcggcgagcagaagaaggccatcgtggacctcctcttcaagacgaaccggaaagtcaccgtgaagcaattaaaggaggactacttcaagaaaatagagtgcttcgacagcgtcgagatctcgggcgtcgaggacaggttcaacgcgtcgctgggcacataccacgacctcctcaagatcattaaagacaaggacttcctggacaacgaggagaacgaggacatcctcgaggacatcgtgctgaccctcaccctgtttgaggaccgggagatgatcgaggagcgcctcaagacgtacgctcaccttttcgacgacaaggtgatgaaacagctgaagcggcgccgctacaccggatggggccggctctcccgcaagctcattaatgggatcagggacaagcagtccggcaagaccatactcgatttcctgaagagcgacggcttcgccaaccggaacttcatgcagctcatccacgacgactccctcactttcaaggaggacatccagaaggcccaggtcagcggacagggcgactcgctccacgaacacatcgccaacctggccgggtcgcctgcgattaaaaagggaatccttcagaccgtcaaggtcgtggacgagctggtgaaggtgatgggcaggcacaagcccgaaaatatcgtcattgagatggcccgggagaaccagaccacgcagaaaggccagaagaacagccgggagcgcatgaaacggatcgaggagggtatcaaggagctgggctcgcagatcctcaaggagcaccctgtggaaaatacccagctgcagaatgaaaagctctacctctactacctccagaacggccgcgacatgtacgtggaccaggagctggacattaatcgcctctcggactacgacgtcgaccacatcgtcccgcagtccttcctgaaggacgacagcatcgacaacaaggtcttgacccgctccgataaaaatcgcgggaagtccgacaacgtgccgtcggaggaggtggtcaagaagatgaaaaactactggcgccagctgctcaacgccaagctaatcacgcagcgcaagttcgacaacctcaccaaggccgaacgcggcggtctctccgagcttgataaggctgggttcatcaagagacagctggtggagacccggcagatcaccaagcatgtcgcccagatcctggactcgcgcatgaatactaagtacgatgaaaacgacaagctcatccgcgaggtgaaggtgatcaccctgaagagcaagctggtctcggacttccggaaggacttccagttctacaaggtccgggagatcaacaactaccaccacgcgcacgacgcctacctgaacgcggtggtgggcacagcccttataaagaagtaccctaagctcgagtccgagttcgtgtacggcgactacaaggtgtacgacgtccgcaagatgatcgcgaagagcgagcaggagatcgggaaggccaccgcaaaatacttcttctactccaacatcatgaacttcttcaagaccgagatcaccctggccaacggggagatccgcaagcgcccgctgattgagacgaacggagagacaggcgagatagtctgggacaagggcagggacttcgccaccgtgcgcaaggttctgtccatgccgcaggtgaacatcgtgaagaagactgaggtgcagacaggcggcttctcgaaggagtccatcctgcccaagcggaacagcgacaagctcatcgcgcggaagaaggactgggaccctaaaaaatatggcgggttcgactcgcccaccgtggcttactcggtcctcgtggtggccaaggtcgagaagggcaaaagcaagaagctgaagagcgtcaaggagctcctcggcatcaccatcatggagcggtccagcttcgagaagaacccgatcgacttcctcgaggcgaagggatataaggaggtgaagaaggacctcatcattaaactgccgaagtactcgctattcgaactggagaatggtcgcaagaggatgctcgcgagcgctggcgagctgcagaaagggaacgagctggctctcccgagcaagtacgtcaacttcctctacctggcctcccactatgaaaagctcaagggctcgccggaggacaacgagcagaagcagctgttcgtcgagcagcacaagcattacctcgacgagatcatcgagcagatctcggagttcagcaagcgcgtgatcctggccgacgccaacctcgacaaggtgctgtccgcatataacaagcaccgcgacaaaccaatacgggagcaggccgaaaatatcatccacctgttcaccctcacgaacctgggcgcccccgccgcgttcaagtacttcgacacaaccatcgaccgcaagcggtacacgagcacgaaggaggtgctggacgccacgttgattcaccagtccatcacgggcctgtatgaaacaaggatcgatctcagccagctcggcggcgactaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggc

SEQ ID NO: 194 - DNA, 100 bp, synthetic construct
  misc_feature 1..100: note = synthesized sequence- DNA version of guide RNA (EPSPS sgRNA)
  source 1..100: mol_type = other DNA
gcagtaacagctgctgtcaagttttagagctagaaatagcaagttaaaataaggctagtccgttatcaacttgaaaaagtggcaccgagtcggtgctttt

SEQ ID NO: 195 - DNA, 3708 bp, synthetic construct
  misc_feature 1..3708: note = synthesized sequence- EPSPS polynucleotide template
  source 1..3708: mol_type = other DNA
ctgcagcccatcaaggagatctccggcaccgtcaagctgccggggtccaagtcgctttccaacaggatcctcctgctcgccgccctgtccgaggtgagcgattttggtgcttgctgcgctgccctgtctcactgctacctaaatgttttgcctgtcgaataccatggattctcggtgtaatccatctcacgatcagatgcaccgcatgtcgcatgcctagctctctctaatttgtctagtagtttgtatacggattaagattgataaatcggtaccgcaaaagctaggtgtaaataaacactacaaaattggatgttcccctatcggcctgtactcggctactcgttcttgtgatggcatgttatttcttcttggtgtttggtgaactcccttatgaaatttgggcgcaaagaaatcgccctcaagggttgatcttatgccatcgtcatgataaacagtgaagcacggatgatcctttacgttgtttttaacaaactttgtcagaaaactagcaatgttaacttcttaatgatgatttcacaacaaaaaaggtaaccttgctactaacataacaaaagacttgttgcttattaattatatgtttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctaaagaggaagtgcagctcttcttggggaatgctggaatcgcaatgcggtcattgacagcagctgttactgctgctggtggaaatgcaacgtatgtttcctctctctctctacaatacttgttggagttagtatgaaacccatgtgtatgtctagtggcttatggtgtattggtttttgaacttcagttacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggttagttactaagggccacatgttacattcttctgtaaatggtacaactattgtcgagcttttgcatttgtaaggaaaacattgattgatctgaatttgatgctacaccacaaaatatctacaaatggtcatccctaactagcaaaccatgtctccattaagctcaatgaagtaatacttggcatgtgtttatcaacttaatttccatcttctggggtattgcctgttttctagtctaatagcatttgtttttagaattagctcttacaactgttatgttctacaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtaagctctgtaatgtatttcactactttgatgccaatgtttcagttttcagttttccaaacagtcgcatcaatatttgaatagatgcactgtagaaaaaaatcattgcagggaaaaactagtactgagtattttgactgtaaattatttaaccagtcggaatatagtcagtctattggagtcaagagcgtgaaccgaaatagccagttaattatcccattatacagaggacaaccatgtatactattgaaacttggtttaagagaatctaggtagctggactcgtagctgcttggcatggataccttcttatctttaggaaaagacacttgattttttttctgtggccctctatgatgtgtgaacctgcttctctattgctttagaaggatatatctatgtcgttatgcaacatgcttcccttagtcatttgtactgaaatcagtttcataagttcgttagtggttccctaaacgaaaccttgtttttctttgcaatcaacaggtcccctaaaaatgcctatgttgaaggtgatgcctcaagcgcaagctatttcttggctggtgctgcaattactggagggactgtgactgtggaaggttgtggcaccaccagtttgcaggtaaagatttcttggctggtgctacgataactgcttttgtctttttggtttcagcattgttctcagagtcactaaataacattatcatctgcaaacgtcaaatagacatacttaggtgaatggatattcatgtaaccgtttccttacaaatttgctgaaacctcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacggtaaaacattctcagccctacaaccatgcctcttctacatcactacttgacaagactaaaaactattggctcgttggcagtggcttcctggagagtaaaggagaccgagaggatggttgcgatccggacggagctaaccaaggtaaggctacatacttcacatgtctcacgtcgtctttccatagctcgctgcctcttagcggcttgcctgcggtcgctccatcctcggttgctgtctgtgttttccacagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtgaccatccgggaccctgggtgcacccggaagaccttccccgactacttcgatgtgctgagcactttcgtcaagaattaataaagcgtgcgatactaccacgcagcttgattgaagtgataggcttgtgctgaggaaatacatttcttttgttctgttttttctctttcacgggattaagttttgagtctgtaacgttagttgtttgtagcaagtttctatttcggatcttaagtttgtgcactgtaagccaaatttcatttcaagagtggttcgttggaataataagaataataaattacgtttcagtggctgtcaagcctgctgctacgttttaggagatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccatgtatagtatgttctttctttgagtctcatttaactacctctacacataccaactttagttttttttctacctcttcatgttactatggtgccttcttatcccactgagcattggtatatttagaggtttttgttgaacatgcctaaatcatctcaatcaacgatggacaatcttttcttcgattgagctgaggtacgtcatctaga

SEQ ID NO: 196 - DNA, 15 bp, synthetic construct
  misc_feature 1..15: note = synthesized sequence- TIPS nucleotide modifications
  source 1..15: mol_type = other DNA
atcgcaatgcggtca

SEQ ID NO: 197 - DNA, 19 bp, synthetic construct
  misc_feature 1..19: note = synthesized sequence- Primer Seqeunce-1 F-E2
  source 1..19: mol_type = other DNA
ccgaggagatcgtgctgca

SEQ ID NO: 198 - DNA, 20 bp, synthetic construct
  misc_feature 1..20: note = synthesized sequence- Primer Seqeunce-2 F-E2
  source 1..20: mol_type = other DNA
caatggccgcattgcagttc

SEQ ID NO: 199 - DNA, 19 bp, synthetic construct
  misc_feature 1..19: note = synthesized sequence- Primer Seqeunce-1 F-T
  source 1..19: mol_type = other DNA
ccgaggagatcgtgctgca

SEQ ID NO: 200 - DNA, 20 bp, synthetic construct
  misc_feature 1..20: note = synthesized sequence- Primer Seqeunce-2 F-T
  source 1..20: mol_type = other DNA
tgaccgcattgcgattccag

SEQ ID NO: 201 - DNA, 24 bp, synthetic construct
  misc_feature 1..24: note = synthesized sequence- Primer Seqeunce-1 H-T
  source 1..24: mol_type = other DNA
tccaagtcgctttccaacaggatc

SEQ ID NO: 202 - DNA, 20 bp, synthetic construct
  misc_feature 1..20: note = synthesized sequence- Primer Seqeunce-2 H-T
  source 1..20: mol_type = other DNA
tgaccgcattgcgattccag

SEQ ID NO: 203 - DNA, 19 bp, synthetic construct
  misc_feature 1..19: note = synthesized sequence- Primer Seqeunce-1 F-E3
  source 1..19: mol_type = other DNA
ccgaggagatcgtgctgca

SEQ ID NO: 204 - DNA, 24 bp, synthetic construct
  misc_feature 1..24: note = synthesized sequence- Primer Seqeunce-2 F-E3
  source 1..24: mol_type = other DNA
accaagctgcttcaatccgacaac

SEQ ID NO: 205 - DNA, 63 bp, Zea mays
  source 1..63: mol_type = genomic DNA
ggggaatgctggaactgcaatgcggccattgacagcagctgttactgctgctggtggaaatgc

SEQ ID NO: 206 - DNA, 60 bp, Zea mays
  source 1..60: mol_type = genomic DNA
ggggaatgctggaactgcaatgcggccattggcagctgttactgctgctggtggaaatgc

SEQ ID NO: 207 - DNA, 50 bp, Zea mays
  source 1..50: mol_type = genomic DNA
ggggaatgctggaactgcacagcagctgttactgctgctggtggaaatgc

SEQ ID NO: 208 - DNA, 33 bp, Zea mays
  source 1..33: mol_type = genomic DNA
ggggaatgctgttactgctgctggtggaaatgc

SEQ ID NO: 209 - DNA, 51 bp, Zea mays
  source 1..51: mol_type = genomic DNA
aatgctggaatcgcaatgcggtcattgacagcagctgttactgctgctggt

SEQ ID NO: 210 - DNA, 51 bp, Zea mays
  source 1..51: mol_type = genomic DNA
aatgctggaactgcaatgcggccattgacagcagctgttactgctgctggt

SEQ ID NO: 211 - DNA, 5124 bp, Zea mays
  source 1..5124: mol_type = genomic DNA
atggcggccatggcgaccaaggccgccgcgggcaccgtgtcgctggacctcgccgcgccgccggcggcggcagcggcggcggcggtgcaggcgggtgccgaggagatcgtgctgcagcccatcaaggagatctccggcaccgtcaagctgccggggtccaagtcgctttccaacaggatcctcctgctcgccgccctgtccgaggtgagcgattttggtgcttgctgcgctgccctgtctcactgctacctaaatgttttgcctgtcgaataccatggattctcggtgtaatccatctcacgatcagatgcaccgcatgtcgcatgcctagctctctctaatttgtctagtagtttgtatacggattaagattgataaatcggtaccgcaaaagctaggtgtaaataaacactacaaaattggatgttcccctatcggcctgtactcggctactcgttcttgtgatggcatgttatttcttcttggtgtttggtgaactcccttatgaaatttgggcgcaaagaaatcgccctcaagggttgatcttatgccatcgtcatgataaacagtgaagcacggatgatcctttacgttgtttttaacaaactttgtcagaaaactagcaatgttaacttcttaatgatgatttcacaacaaaaaaggtaaccttgctactaacataacaaaagacttgttgcttattaattatatgtttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctaaagaggaagtgcagctcttcttggggaatgctggaactgcaatgcggccattgacagcagctgttactgctgctggtggaaatgcaacgtatgtttcctctctctctctacaatacttgttggagttagtatgaaacccatgtgtatgtctagtggcttatggtgtattggtttttgaacttcagttacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggttagttactaagggccacatgttacattcttctgtaaatggtacaactattgtcgagcttttgcatttgtaaggaaaacattgattgatctgaatttgatgctacaccacaaaatatctacaaatggtcatccctaactagcaaaccatgtctccattaagctcaatgaagtaatacttggcatgtgtttatcaacttaatttccatcttctggggtattgcctgttttctagtctaatagcatttgtttttagaattagctcttacaactgttatgttctacaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtaagctctgtaatgtatttcactactttgatgccaatgtttcagttttcagttttccaaacagtcgcatcaatatttgaatagatgcactgtagaaaaaaatcattgcagggaaaaactagtactgagtattttgactgtaaattatttaaccagtcggaatatagtcagtctattggagtcaagagcgtgaaccgaaatagccagttaattatcccattatacagaggacaaccatgtatactattgaaacttggtttaagagaatctaggtagctggactcgtagctgcttggcatggataccttcttatctttaggaaaagacacttgattttttttctgtggccctctatgatgtgtgaacctgcttctctattgctttagaaggatatatctatgtcgttatgcaacatgcttcccttagtcatttgtactgaaatcagtttcataagttcgttagtggttccctaaacgaaaccttgtttttctttgcaatcaacaggtcccctaaaaatgcctatgttgaaggtgatgcctcaagcgcaagctatttcttggctggtgctgcaattactggagggactgtgactgtggaaggttgtggcaccaccagtttgcaggtaaagatttcttggctggtgctacgataactgcttttgtctttttggtttcagcattgttctcagagtcactaaataacattatcatctgcaaacgtcaaatagacatacttaggtgaatggatattcatgtaaccgtttccttacaaatttgctgaaacctcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacggtaaaacattctcagccctacaaccatgcctcttctacatcactacttgacaagactaaaaactattggctcgttggcagtggcttcctggagagtaaaggagaccgagaggatggttgcgatccggacggagctaaccaaggtaaggctacatacttcacatgtctcacgtcgtctttccatagctcgctgcctcttagcggcttgcctgcggtcgctccatcctcggttgctgtctgtgttttccacagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtgaccatccgggaccctgggtgcacccggaagaccttccccgactacttcgatgtgctgagcactttcgtcaagaattaataaagcgtgcgatactaccacgcagcttgattgaagtgataggcttgtgctgaggaaatacatttcttttgttctgttttttctctttcacgggattaagttttgagtctgtaacgttagttgtttgtagcaagtttctatttcggatcttaagtttgtgcactgtaagccaaatttcatttcaagagtggttcgttggaataataagaataataaattacgtttcagtggctgtcaagcctgctgctacgttttaggagatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccatgtatagtatgttctttctttgagtctcatttaactacctctacacataccaactttagttttttttctacctcttcatgttactatggtgccttcttatcccactgagcattggtatatttagaggtttttgttgaacatgcctaaatcatctcaatcaacgatggacaatcttttcttcgattgagctgaggtacgtcatctagaggataggaccttgagaatatgtgtccgtcaatagctaaccctctactaattttttcaatcaagcaacctattggcttgactttaattcgtaccggcttctactacttctacagtattttgtctctataaattgcagctacaacagtcagaacggctggctttaaaatcaaatggcctaaggatcattgaaaggcatcttagcaatgtctaaaattattaccttctctagacgttgatatctttgctccggattcgatcccttgttgtatgaccacaaatccaacaccaaatacgcatttctgcaacacacccaaacaccccttccaaataagtggaatggttgagaaatttgctattttgattaaatattggtgaaggggcaaggctgaggaaacgagacgaaggttccttgacagctgaaaaatggaacactctagaggcggagggagcgaggcgagctgtgtgaattgccacccattgattaagaatccaacaacttgactagcaaatgccgacatgggtagcctacaaaggcgagttttggagctggtttcgtaataaggaaatttctcaaccaactactttccttagaaaagagttgcttgaccggatcaacatctccccctaaaccccttggagggggagggggctaagattttaatctacaagttagatctaactgtccacctcaatccccctcaaggaggtttttgtattatttgttagtgtagaatgataaagtggatgtattgataggagatggggtacacatatttatagggactcaaccctaaccctaatgggtcggcagcccaacagtggtgtccggcccacacacacactcacacacacagtctaacatcccccgcagtcgcaacggggacaccacacacgatgagactggagtagaggccgaaggtaggagccgacgggttgaaatcccccctagtcgcagcgtcgtgatagtacgaatgttgcggctggagtagagaccggtgtgtgctccaagaagacgatagcccctagatgccgaggtagccgaagtcgaggtggtcgcggtcggaagacgcgcagcaaaagcctgatcttcgggatggtcgacgttcgagcgtcaacgatcggtagggcgacacaataaaagggcaccagcaggtcgaccttcctgcttcttcgatcgtccagacgtcaaggagcctcgctagggaggccgacggcagcgcacgcggctacgccggtcatggtgtcctcacccgcggcagaaaagaaggggaatgtcggatccgaccgagaaggccacggcagcga

SEQ ID NO: 212 - DNA, 3387 bp, Streptococcus thermophilus
  source 1..3387: mol_type = genomic DNA
atgagtgacttagttttaggacttgatatcggtataggttctgttggtgtaggtatccttaacaaagtgacaggagaaattatccataaaaactcacgcatcttcccagcagctcaagcagaaaataacctagtacgtagaacgaatcgtcaaggaagacgcttgacacgacgtaaaaaacatcgtatagttcgtttaaatcgtctatttgaggaaagtggattaatcaccgattttacgaagatttcaattaatcttaacccatatcaattacgagttaagggcttgaccgatgaattgtctaatgaagaactgtttatcgctcttaaaaatatggtgaaacaccgtgggattagttacctcgatgatgctagtgatgacggaaattcatcagtaggagactatgcacaaattgttaaggaaaatagtaaacaattagaaactaagacaccgggacagatacagttggaacgctaccaaacatatggtcaattacgtggtgattttactgttgagaaagatggcaaaaaacatcgcttgattaatgtctttccaacatcagcttatcgttcagaagccttaaggatactgcaaactcaacaagaatttaatccacagattacagatgaatttattaatcgttatctcgaaattttaactggaaaacggaaatattatcatggacccggaaatgaaaagtcacggactgattatggtcgttacagaacgagtggagaaactttagacaatatttttggaattctaattgggaaatgtacattttatccagaagagtttagagcagcaaaagcttcctacacggctcaagaattcaatttgctaaatgatttgaacaatctaacagttcctactgaaaccaaaaagttgagcaaagaacagaagaatcaaatcattaattatgtcaaaaatgaaaaggcaatggggccagcgaaactttttaaatatatcgctaagttactttcttgtgatgttgcagatatcaagggataccgtatcgacaaatcaggtaaggctgagattcatactttcgaagcctatcgaaaaatgaaaacgcttgaaaccttagatattgaacaaatggatagagaaacgcttgataaattagcctatgtcttaacattaaacactgagagggaaggtattcaagaagccttagaacatgaatttgctgatggtagctttagccagaagcaagttgacgaattggttcaattccgcaaagcaaatagttccatttttggaaaaggatggcataatttttctgtcaaactgatgatggagttaattccagaattgtatgagacgtcagaagagcaaatgactatcctgacacgacttggaaaacaaaaacgacttcgtcttcaaataaaacaaaatatttcaaataaaacaaaatatatagatgagaaactattaactgaagaaatctataatcctgttgttgctaagtctgttcgccaggctataaaaatcgtaaatgcggcgattaaagaatacggagactttgacaatattgtcatcgaaatggctcgtgaaacaaatgaagatgatgaaaagaaagctattcaaaagattcaaaaagccaacaaagatgaaaaagatgcagcaatgcttaaggctgctaaccaatataatggaaaggctgaattaccacatagtgttttccacggtcataagcaattagcgactaaaatccgcctttggcatcagcaaggagaacgttgcctttatactggtaagacaatctcaatccatgatttgataaataatcctaatcagtttgaagtagatcatattttacctctttctatcacattcgatgatagccttgcaaataaggttttggtttatgcaactgctaaccaagaaaaaggacaacgaacaccttatcaggctttagatagtatggatgatgcgtggtctttccgtgaattaaaagcttttgtacgtgagtcaaaaacactttcaaacaagaaaaaagaatacctccttacagaagaagatatttcaaagtttgatgttcgaaagaaatttattgaacgaaatcttgtagatacaagatacgcttcaagagttgtcctcaatgcccttcaagaacactttagagctcacaagattgatacaaaagtttccgtggttcgtggccaatttacatctcaattgagacgccattggggaattgagaagactcgtgatacttatcatcaccatgctgtcgatgcattgattattgccgcctcaagtcagttgaatttgtggaaaaaacaaaagaatacccttgtaagttattcagaagaacaactccttgatattgaaacaggtgaacttattagtgatgatgagtacaaggaatctgtgttcaaagccccttatcaacattttgttgatacattgaagagtaaagaatttgaagacagtatcttattctcatatcaagtggattctaagtttaatcgtaaaatatcagatgccactatttatgcgacaagacaggctaaagtgggaaaagataagaaggatgaaacttatgtcttagggaaaatcaaagatatctatactcaggatggttatgatgcctttatgaagatttataagaaggataagtcaaaattcctcatgtatcgtcacgacccacaaacctttgagaaagttatcgagccaattttagagaactatcctaataagcaaatgaatgaaaaaggaaaagaggtaccatgtaatcctttcctaaaatataaagaagaacatggctatattcgtaaatatagtaaaaaaggcaatggtcctgaaatcaagagtcttaaatactatgatagtaagcttttaggtaatcctattgatattactccagagaatagtaaaaataaagttgtcttacagtcattaaaaccttggagaacagatgtctatttcaataaggctactggaaaatacgaaatccttggattaaaatatgctgatctacaatttgagaaagggacaggaacatataagatttcccaggaaaaatacaatgacattaagaaaaaagagggtgtagattctgattcagaattcaagtttacactttataaaaatgatttgttactcgttaaagatacagaaacaaaagaacaacagcttttccgttttctttctcgaactttacctaaacaaaagcattatgttgaattaaaaccttatgataaacagaaatttgaaggaggtgaggcgttaattaaagtgttgggtaacgttgctaatggtggtcaatgcataaaaggactagcaaaatcaaatatttctatttataaagtaagaacagatgtcctaggaaatcagcatatcatcaaaaatgagggtgataagcctaagctagatttttaa

SEQ ID NO: 213 - DNA, 3369 bp, Streptococcus thermophilus
  source 1..3369: mol_type = genomic DNA
atgagtgacttagttttaggacttgatatcggtataggttctgttggtgtaggtatccttaacaaagtgacaggagaaattatccataaaaactcacgcatcttcccagcagctcaagcagaaaataacctagtacgtagaacgaatcgtcaaggaagacgcttgacacgacgtaaaaaacatcgtatagttcgtttaaatcgtctatttgaggaaagtggattaatcaccgattttacgaagatttcaattaatcttaacccatatcaattacgagttaagggcttgaccgatgaattgtctaatgaagaactgtttatcgctcttaaaaatatggtgaaacaccgtgggattagttacctcgatgatgctagtgatgacggaaattcatcagtaggagactatgcacaaattgttaaggaaaatagtaaacaattagaaactaagacaccgggacagatacagttggaacgctaccaaacatatggtcaattacgtggtgattttactgttgagaaagatggcaaaaaacatcgcttgattaatgtctttccaacatcagcttatcgttcagaagccttaaggatactgcaaactcaacaagaatttaattcacagattacagatgaatttattaatcgttatctcgaaattttaactggaaaacggaaatattatcatggacccggaaatgaaaagtcacggactgattatggtcgttacagaacgaatggagaaactttagacaatatttttggaattctaattgggaaatgtacattttatccagacgagtttagagcagcaaaagcttcctacacggctcaagaattcaatttgctaaatgatttgaacaatctaacagttcctactgaaaccaaaaagttgagcaaagaacagaagaatcaaatcattaattatgtcaaaaatgaaaaggtaatggggccagcgaaactttttaaatatatcgctaaattactttcttgtgatgttgcagatatcaagggacaccgtatcgacaaatcaggtaaggctgagattcatactttcgaagcctatcgaaaaatgaaaacgcttgaaaccttagatattgagcaaatggatagagaaacgcttgataaattagcctatgtcttaacattaaacactgagagggaaggtattcaagaagctttagaacatgaatttgctgatggtagctttagccagaagcaagttgacgaattggttcaattccgcaaagcaaatagttccatttttggaaaaggatggcataatttttctgtcaaactgatgatggagttaattccagaattgtatgagacgtcagaagagcaaatgactatcctgacacgacttggaaaacaaaaaacaacttcgtcttcaaataaaacaaaatatatagatgagaaactattaactgaagaaatctataatcctgttgttgctaagtctgttcgccaggctataaaaatcgtaaatgcggcgattaaagaatacggagactttgacaatattgtcatcgaaatggctcgtgaaacaaatgaagatgatgaaaagaaagctattcaaaagattcaaaaagccaacaaagatgaaaaagatgcagcaatgcttaaggctgctaaccaatataatggaaaggctgaattaccacatagtgttttccacggtcataagcaattagcgactaaaatccgcctttggcatcagcaaggagaacgttgcctttatactggtaagacaatctcaatccatgatttgataaataatcctaatcagtttgaagtagatcatattttacctctttctatcacattcgatgatagccttgcaaataaggttttggtttatgcaactgctaaccaagaaaaaggacaacgaacaccttatcaggctttagatagtatggatgatgcgtggtctttccgtgaattaaaagcttttgtacgtgagtcaaaaacactttcaaacaagaaaaaagaatacctccttacagaagaagatatttcaaagtttgatgttcgaaagaaatttattgaacgaaatcttgtagatacaagatacgcttcaagagttgtcctcaatgcccttcaagaacactttagagctcacaagattgatacaaaagtttccgtggttcgtggccaatttacatctcaattgagacgccattggggaattgagaagactcgtgatacttatcatcaccatgctgtcgatgcattgattattgccgcctcaagtcagttgaatttgtggaaaaaacaaaagaatacccttgtaagttattcagaagaacaactccttgatattgaaacaggtgaacttattagtgatgatgagtacaaggaatctgtgttcaaagccccttatcaacattttgttgatacattgaagagtaaagaatttgaagacagtatcttattctcatatcaagtggattctaagtttaatcgtaaaatatcagatgccactatttatgcgacaagacaggctaaagtgggaaaagataagaaggatgaaacttatgtcttagggaaaatcaaagatatctatactcaggatggttatgatgcctttatgaagatttataagaaggataagtcaaaattcctcatgtatcgtcacgacccacaaacctttgagaaagttatcgagccaattttagagaactatcctaataaggaaatgaatgaaaaagggaaagaagtaccatgtaatcctttcctaaaatataaagaagaacatggctatattcgtaaatatagtaaaaaaggcaatggtcctgaaatcaagagtcttaaatactatgatagtaagcttttaggtaatcctattgatattactccagagaatagtaaaaataaagttgtcttacagtcattaaaaccttggagaacagatgtctatttcaataaaaatactggtaaatatgaaattttaggactgaaatatgctgatttacaatttgaaaagaagacaggaacatataagatttcccaggaaaaatacaatggcattatgaaagaagagggtgtagattctgattcagaattcaagtttacactttataaaaatgatttgttactcgttaaagatacagaaacaaaagaacaacagcttttccgttttctttctcgaactatgcctaatgtgaaatattatgtagagttaaagccttattcaaaagataaatttgagaagaatgagtcacttattgaaattttaggttctgcagataagtcaggacgatgtataaaagggctaggaaaatcaaatatttctatttataaggtaagaacagatgtcctaggaaatcagcatatcatcaaaaatgagggtgataagcctaagctagatttttaa

SEQ ID NO: 214 - DNA, 4113 bp, Streptococcus agalactiae
  source 1..4113: mol_type = genomic DNA
atgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagagggagcaagtatcctatctttgcaacattgcaggaagagaaagattatcatgaaaaattttcgacaatctatcatttgagaaaagaattagctgacaagaaagaaaaagcagaccttcgtcttatttatattgctctagctcatatcattaaatttagagggcatttcctaattgaggatgatagctttgatgtcaggaatacagacatttcaaaacaatatcaagattttttagaaatctttaatacaacttttgaaaataatgatttgttatctcaaaacgttgacgtagaggcaatactaacagataagattagcaagtctgcgaagaaagatcgtattttagcgcagtatcctaaccaaaaatctactggcatttttgcagaatttttgaaattgattgtcggaaatcaagctgacttcaagaaatatttcaatttggaggataaaacgccgcttcaattcgctaaggatagctacgatgaagatttagaaaatcttcttggacagattggtgatgaatttgcagacttattctcagcagcgaaaaagttatatgatagtgtccttttgtctggcattcttacagtaatcgacctcagtaccaaggcgccactttcagcttctatgattcagcgttatgatgaacatagagaggacttgaaacagttaaaacaattcgtaaaagcttcattgccggaaaaatatcaagaaatatttgctgattcatcaaaagatggctacgctggttatattgaaggtaaaactaatcaagaagctttttataaatacctgtcaaaattgttgaccaagcaagaagatagcgagaattttcttgaaaaaatcaagaatgaagatttcttgagaaaacaaaggacctttgataatggctcaattccacaccaagtccatttgacagagctgaaagctattatccgccgtcaatcagaatactatcccttcttgaaagagaatcaagataggattgaaaaaatccttacctttagaattccttattatatcgggccactagcacgtgagaagagtgattttgcatggatgactcgcaaaacagatgacagtattcgaccttggaattttgaagacttggttgataaagaaaaatctgcggaagcttttatccatcgtatgaccaacaatgatttttatcttcctgaagaaaaagttttaccaaagcatagtcttatttatgaaaaatttacggtctataatgagttgactaaggttagatataaaaatgagcaaggtgagacttatttttttgatagcaatattaaacaagaaatctttgatggagtattcaaggaacatcgtaaggtatccaagaagaagttgctagattttctggctaaagaatatgaggagtttaggatagtagatgttattggtctagataaagaaaataaagctttcaacgcctcattgggaacttaccacgatctcgaaaaaatactagacaaagattttctagataatccagataatgagtctattctggaagatatcgtccaaactctaacattatttgaagacagagaaatgattaagaagcgtcttgaaaactataaagatctttttacagagtcacaactaaaaaaactctatcgtcgtcactatactggctggggacgattgtctgctaagttaatcaatggtattcgagataaagagagtcaaaaaacaatcttggactatcttattgatgatggtagatctaatcgcaactttatgcagttgataaatgatgatggtctatctttcaaatcaattatcagtaaggcacaggctggtagtcattcagataatctaaaagaagttgtaggtgagcttgcaggtagccctgctattaaaaagggaattctacaaagtttgaaaattgttgatgagcttgttaaagtcatgggatacgaacctgaacaaattgtggttgagatggcgcgtgagaatcaaacaacaaatcaaggtcgtcgtaactctcgacaacgctataaacttcttgatgatggcgttaagaatctagctagtgacttgaatggcaatattttgaaagaatatcctacggataatcaagcgttgcaaaatgaaagacttttcctttactacttacaaaacggaagagatatgtatacaggggaagctctagatattgacaatttaagtcaatatgatattgaccacattattcctcaagctttcataaaagatgattctattgataatcgtgttttggtatcatctgctaaaaatcgtggaaagtcagatgatgttcctagccttgaaattgtaaaagattgtaaagttttctggaaaaaattacttgatgctaagttaatgagtcagcgtaagtatgataatttgactaaggcagagcgcggaggcctaacttccgatgataaggcaagatttatccaacgtcagttggttgagacacgacaaattaccaagcatgttgcccgtatcttggatgaacgctttaataatgagcttgatagtaaaggtagaaggatccgcaaagttaaaattgtaaccttgaagtcaaatttggtttcaaatttccgaaaagaatttggattctataaaattcgtgaagttaacaattatcaccatgcacatgatgcctatcttaatgcagtagttgctaaagctattctaaccaaatatcctcagttagagccagaatttgtctacggcgactatccaaaatataatagttacaaaacgcgtaaatccgctacagaaaagctatttttctattcaaatattatgaacttctttaaaactaaggtaactttagcggatggaaccgttgttgtaaaagatgatattgaagttaataatgatacgggtgaaattgtttgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaagggtaaagcacaaaaactaaaaacagttacggaacttttaggaattaccatcatggagaggtccagatttgagaaaaatccatcagctttccttgaatcaaaaggctatttaaatattagggctgataaactaattattttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaagataataaggaaaatatatcagtagatgaacttgctaataatattatcaatctatttacttttaccagtctaggagctccagcagcttttaaattttttgataaaatagttgatagaaaacgctatacatcaactaaagaagtacttaattctaccctaattcatcaatctattactggactttatgaaacacgtattgatttgggtaagttaggagaagattga

SEQ ID NO: 215 - DNA, 4134 bp, Streptococcus pyogenes
  source 1..4134: mol_type = genomic DNA
atgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagaggtagcaagtatcctatctttgcaacaatgcaggaggagaaatattatcatgaaaaatttccgacaatctatcatttgagaaaagaattggctgacaagaaagaaaaagcagaccttcgtcttgtttatctggctctagctcatatcattaaattcagagggcatttcctaattgaggatgatagatttgatgtgaggaataccgatattcaaaaacaatatcaagcctttttagaaatttttgatactacctttgaaaataatcatttgttatctcaaaatgtagatgtagaagcaattctaacagataagattagcaagtctgcgaagaaggatcgcatcttagcgcagtatcctaaccaaaaatctactggtatttttgcagaatttttgaaattgattgtcggaaatcaagctgacttcaagaaacatttcaatttggaggataaaacaccgcttcaattcgctaaggatagctacgatgaagatttagaaaatcttcttggacagattggtgatgaatttgcagacttattctcagtagcgaaaaagctatatgatagtgttcttttatctggcattcttacagtaactgatctcagtaccaaggcgccactttctgcctctatgattcagcgttatgatgaacatcatgaggacttaaagcatctaaaacaattcgtaaaagcttcattacctgaaaattatcgggaagtatttgctgattcatcaaaagatggctacgctggctatattgaaggcaaaactaatcaagaagctttttataaatatctgttaaaattgttgaccaaacaagaaggtagcgagtattttcttgagaaaattaagaatgaagattttttgagaaaacagagaacctttgataatggctcaatcccgcatcaagtccatttgacagaattgagggctattattcgacgtcaatcagaatactatccattcttgaaagagaatcaagataggattgaaaaaatccttacctttagaattccttattatgtcgggccactagcacgtgagaagagtgattttgcatggatgactcgcaaaacagatgacagtattcgaccttggaattttgaagacttggttgataaagaaaaatctgcggaagcttttatccatcgcatgaccaacaatgacctctatcttccagaagaaaaagttttaccaaagcatagtcttatttatgaaaaatttactgtttacaatgaattaacgaaggttagatttttggcagaaggctttaaagattttcaatttttaaataggaagcaaaaagaaactatctttaacagcttgtttaaggaaaaacgtaaagtaactgaaaaggatattattagttttttgaataaagttgatggatatgaaggaattgcaatcaaaggaattgagaaacagtttaacgctagcctttcaacctatcatgatcttaaaaaaatacttggcaaggatttccttgataatacagataacgagcttattttggaagatatcgtccaaactctaaccttatttgaagatagagaaatgattaagaagtgtcttgacatctataaagatttttttacagagtcacagcttaaaaagctctatcgccgtcactatactggctggggacgattgtctgctaagctaataaatggcatccgaaataaagagaatcaaaaaacaatcttggactatcttattgatgatggaagtgcaaaccgaaacttcatgcagttgataaatgatgatgatctatcatttaaaccaattattgacaaggcacgaactggtagtcattcggataatctgaaagaagttgtaggtgaacttgctggtagccctgctattaaaaaagggattctacaaagtttgaaaatagttgatgagctggttaaagtcatgggctatgaacctgaacaaatcgtggttgaaatggcacgtgagaaccaaacgacagcaaaaggattaagtcgttcacgacaacgcttgacaaccttgagagaatctcttgctaatttgaagagtaatattttggaagagaaaaagcctaagtatgtgaaagatcaagttgaaaatcatcatttatctgatgaccgtcttttcctttactacttacaaaacggaagagatatgtatacaaaaaaggctctggatattgataatttaagtcaatatgatattgaccacattattcctcaagctttcataaaagatgattctattgataatcgtgttttggtatcatctgctaaaaatcgtggaaaatcagatgatgttcctagcattgaaattgtaaaagctcgcaaaatgttctggaaaaatttactggatgctaagttaatgagtcagcgtaagtatgataatttgactaaggcagagcgcggaggcctaacttccgatgataaggcaagatttatccaacgtcagttggttgagactcgacaaattaccaagcatgtagctcgtatcttggatgaacgcttcaataatgaagttgataatggtaaaaagatttgcaaggttaaaattgtaaccttgaagtcaaatttggtttcaaatttccgaaaagaatttggattctataaaattcgtgaagttaatgattatcaccatgcacacgatgcttatcttaatgcagtagttgccaaagctattctaaccaaatatccacagttagagccagagtttgtctacggaatgtatagacagaaaaaactttcgaaaatcgttcatgaggataaggaagaaaaatatagtgaagcaaccaggaaaatgtttttctactccaacttgatgaatatgttcaaaagagttgtgaggttagcagatggttctattgttgtaagaccagtaatagaaactggtagatatatgagaaaaactgcatgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaaaggtaaagcacaaaaactaaaaacagttacggaacttttaggaattaccatcatggagaggtccagatttgagaaaaatccatcagctttccttgaatcaaaaggttatttaaatattagggacgataaattaatgattttaccgaagtatagtctgttcgaattagaaaatgggcgtcgtcgattacttgctagtgctggtgaattacaaaaaggtaacgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaggataataaggaaaatataccagtagatgaacttgctaataatattatcaatctatttacttttaccagtctaggagctccagcagcttttaaattttttgataaaatagttgatagaaaacgctatacatcaactaaagaagtacttaattctactctaatccatcaatctattactggactttatgaaacacgtattgatttgggtaaattaggagaagattga

SEQ ID NO: 216 - DNA, 4038 bp, Streptococcus pyogenes
  source 1..4038: mol_type = genomic DNA
atgaaaaaaccttactctattggacttgatattggaaccaattctgttggttgggctgttgtgacagatgactacaaagttcctgctaagaagatgaaggttctgggaaatacagataaaagtcatatcgagaaaaatttgcttggcgctttattatttgatagcgggaatactgcagaagacagacggttaaagagaactgctcgccgtcgttacacacgtcgcagaaatcgtattttatatttgcaagagattttttcagaagaaatgggcaaggtagatgatagtttctttcatcgtttagaggattcttttcttgttactgaggataaacgaggagagcgccatcccatttttgggaatcttgaagaagaagttaagtatcatgaaaattttccaaccatttatcatttgcggcaatatcttgcggataatccagaaaaagttgatttgcgtttagtttatttggctttggcacatataattaagtttagaggtcattttttaattgaaggaaagtttgatacacgcaataatgatgtacaaagactgtttcaagaatttttagcagtctatgataatacttttgagaatagttcgcttcaggagcaaaatgttcaagttgaagaaattctgactgataaaatcagtaaatctgctaagaaagatagagttttgaaactttttcctaatgaaaagtctaatggccgctttgcagaatttctaaaactaattgttggtaatcaagctgattttaaaaagcattttgaattagaagagaaagcaccattgcaattttctaaagatacttatgaagaagagttagaagtactattagctcaaattggagataattacgcagagctctttttatcagcaaagaaactgtatgatagtatccttttatcagggattttaacagttactgatgttggtaccaaagcgcctttatctgcttcgatgattcagcgatataatgaacatcagatggatttagctcagcttaaacaattcattcgtcagaaattatcagataaatataacgaagttttttctgatgtttcaaaagacggctatgcgggttatattgatgggaaaacaaatcaagaagctttttataaataccttaaaggtctattaaataagattgagggaagtggctatttccttgataaaattgagcgtgaagattttctaagaaagcaacgtacctttgacaatggctctattccacatcagattcatcttcaagaaatgcgtgctatcattcgtagacaggctgaattttatccgtttttagcagacaatcaagataggattgagaaattattgactttccgtattccctactatgttggtccattagcgcgcggaaaaagtgattttgcttggttaagtcggaaatcggctgataaaattacaccatggaattttgatgaaatcgttgataaagaatcctctgcagaagcttttatcaatcgtatgacaaattatgatttgtacttgccaaatcaaaaagttcttcctaaacatagtttattatacgaaaaatttactgtttacaatgaattaacaaaggttaaatataaaacagagcaaggaaaaacagcattttttgatgccaatatgaagcaagaaatctttgatggcgtatttaaggtttatcgaaaagtaactaaagataaattaatggatttccttgaaaaagaatttgatgaatttcgtattgttgatttaacaggtctggataaagaaaataaagtatttaacgcttcttatggaacttatcatgatttgtgtaaaattttagataaagattttctcgataattcaaagaatgaaaagattttagaagatattgtgttgaccttaacgttatttgaagatagagaaatgattagaaaacgtctagaaaattacagtgatttattgaccaaagaacaagtgaaaaagctggaaagacgtcattatactggttggggaagattatcagctgagttaattcatggtattcgcaataaagaaagcagaaaaacaattcttgattatctcattgatgatggcaatagcaatcggaactttatgcaactgattaacgatgatgctctttctttcaaagaagagattgctaaggcacaagttattggagaaacagacaatctaaatcaagttgttagtgatattgctggcagccctgctattaaaaaaggaattttacaaagcttgaagattgttgatgagcttgtcaaaattatgggacatcaacctgaaaatatcgtcgtggagatggcgcgtgaaaaccagtttaccaatcagggacgacgaaattcacagcaacgtttgaaaggtttgacagattctattaaagaatttggaagtcaaattcttaaagaacatccggttgagaattcacagttacaaaatgatagattgtttctatattatttacaaaacggcagagatatgtatactggagaagaattggatattgattatctaagccagtatgatatagaccatattatcccgcaagcttttataaaggataattctattgataatagagtattgactagctcaaaggaaaatcgtggaaaatcggatgatgtaccaagtaaagatgttgttcgtaaaatgaaatcctattggagtaagctactttcggcaaagcttattacacaacgtaaatttgataatttgacaaaagctgaacgaggtggattgaccgacgatgataaagctggattcatcaagcgtcaattagtagaaacacgacaaattaccaaacatgtagcacgtattctggacgaacgatttaatacagaaacagatgaaaacaacaagaaaattcgtcaagtaaaaattgtgaccttgaaatcaaatcttgtttccaatttccgtaaagagtttgaactctacaaagtgcgtgaaattaatgactatcatcatgcacatgatgcctatctcaatgctgtaattggaaaggctttactaggtgtttacccacaattggaacctgaatttgtttatggtgattatcctcattttcatggacataaagaaaataaagcaactgctaagaaatttttctattcaaatattatgaacttctttaaaaaagatgatgtccgtactgataaaaatggtgaaattatctggaaaaaagatgagcatatttctaatattaaaaaagtgctttcttatccacaagttaatattgttaagaaagtagaggagcaaacgggaggattttctaaagaatctatcttgccgaaaggtaattctgacaagcttattcctcgaaaaacgaagaaattttattgggataccaagaaatatggaggatttgatagcccgattgttgcttattctattttagttattgctgatattgaaaaaggtaaatctaaaaaattgaaaacagtcaaagccttagttggtgtcactattatggaaaagatgacttttgaaagggatccagttgcttttcttgagcgaaaaggctatcgaaatgttcaagaagaaaatattataaagttaccaaaatatagtttatttaaactagaaaacggacgaaaaaggctattggcaagtgctagggaacttcaaaagggaaatgaaatcgttttgccaaatcatttaggaaccttgctttatcacgctaaaaatattcataaagttgatgaaccaaagcatttggactatgttgataaacataaagatgaatttaaggagttgctagatgttgtgtcaaacttttctaaaaaatatactttagcagaaggaaatttagaaaaaatcaaagaattatatgcacaaaataatggtgaagatcttaaagaattagcaagttcatttatcaacttattaacatttactgctataggagcaccggctacttttaaattctttgataaaaatattgatcgaaaacgatatacttcaactactgaaattctcaacgctaccctcatccaccaatccatcaccggtctttatgaaacgcggattgatctcaataagttaggaggagactaa

SEQ ID NO: 217 - DNA, 20 bp, synthetic construct
  misc_feature 1..20: note = synthesized sequence- Mprimer qADH-F
  source 1..20: mol_type = other DNA
caagtcgcggttttcaatca

SEQ ID NO: 218 - DNA, 21 bp, synthetic construct
  misc_feature 1..21: note = synthesized sequence- Primer qADH-R
  source 1..21: mol_type = other DNA
tgaaggtggaagtcccaacaa

SEQ ID NO: 219 - DNA, 19 bp, synthetic construct
  misc_feature 1..19: note = synthesized sequence- probe ADH-VIC
  source 1..19: mol_type = other DNA
tgggaagcctatctaccac

SEQ ID NO: 220 - DNA, 15 bp, synthetic construct
  misc_feature 1..15: note = synthesized sequence- Probe wtEPSPS
  source 1..15: mol_type = other DNA
cggccattgacagca

SEQ ID NO: 221 - DNA, 20 bp, synthetic construct
  misc_feature 1..20: note = synthesized sequence- Forward primer qEPSPS-F
  source 1..20: mol_type = other DNA
tcttggggaatgctggaact

SEQ ID NO: 222 - DNA, 21 bp, synthetic construct
  misc_feature 1..21: note = synthesized sequence- reverse primer qEPSPSR
  source 1..21: mol_type = other DNA
caccagcagcagtaacagctg

SEQ ID NO: 223 - DNA, 17 bp, synthetic construct
  misc_feature 1..17: note = synthesized sequence- FAM-wtEPSPS R probe
  source 1..17: mol_type = other DNA
tgctgtcaatggccgca

SEQ ID NO: 224 - DNA, 20 bp, synthetic construct
  misc_feature 1..20: note = synthesized sequence- forward primer qEPSPS-F
  source 1..20: mol_type = other DNA
tcttggggaatgctggaact

SEQ ID NO: 225 - DNA, 20 bp, synthetic construct
  misc_feature 1..20: note = synthesized sequence- reverse primer q wtEPSPS RA
  source 1..20: mol_type = other DNA
ccaccagcagcagtaacagc

SEQ ID NO: 226 - DNA, 21 bp, synthetic construct
  misc_feature 1..21: note = synthesized sequence- forward primer q epTIPS F
  source 1..21: mol_type = other DNA
ggaagtgcagctcttcttggg

SEQ ID NO: 227 - DNA, 19 bp, synthetic construct
  misc_feature 1..19: note = synthesized sequence- reverse primer q epTIPS R
  source 1..19: mol_type = other DNA
agctgctgtcaatgaccgc

SEQ ID NO: 228 - DNA, 15 bp, synthetic construct
  misc_feature 1..15: note = synthesized sequence- TIPS probe
  source 1..15: mol_type = other DNA
aatgctggaatcgca

SEQ ID NO: 229 - DNA, 23 bp, Zea mays
  misc_feature 1..23: note = MHP14Cas1 target site
  source 1..23: mol_type = genomic DNA
gttaaatctgacgtgaatctgtt

SEQ ID NO: 230 - DNA, 21 bp, Zea mays
  misc_feature 1..21: note = MHP14Cas3 target site
  source 1..21: mol_type = genomic DNA
acaaacattgaagcgacatag

SEQ ID NO: 231 - DNA, 18 bp, Zea mays
  misc_feature 1..18: note = TS8Cas1 target site
  source 1..18: mol_type = genomic DNA
gtacgtaacgtgcagtac

SEQ ID NO: 232 - DNA, 20 bp, Zea mays
  misc_feature 1..20: note = TS8Cas2 target site
  source 1..20: mol_type = genomic DNA
gctcatcagtgatcagctgg

SEQ ID NO: 233 - DNA, 17 bp, Zea mays
  misc_feature 1..17: note = TS9Cas2 target site
  source 1..17: mol_type = genomic DNA
ggctgtttgcggcctcg

SEQ ID NO: 234 - DNA, 21 bp, Zea mays
  misc_feature 1..21: note = TS9Cas3 target site
  source 1..21: mol_type = genomic DNA
gcctcgaggttgcacgcacgt

SEQ ID NO: 235 - DNA, 20 bp, Zea mays
  misc_feature 1..20: note = TS10Cas1 target site
  source 1..20: mol_type = genomic DNA
gcctcgccttcgctagttaa

SEQ ID NO: 236 - DNA, 18 bp, Zea mays
  misc_feature 1..18: note = TS10Cas3 target site
  source 1..18: mol_type = genomic DNA
gctcgtgttggagataca

SEQ ID NO: 237 - DNA, 80 bp, Zea mays
  source 1..80: mol_type = genomic DNA
gttaaatctgacgtgaatctgtttggaattgaaaaacaagtgcttcctttcatacaccactatgtcgcttcaatgtttgt

SEQ ID NO: 238 - DNA, 80 bp, Zea mays
  source 1..80: mol_type = genomic DNA
acaaacattgaagcgacatagtggtgtatgaaaggaagcacttgtttttcaattccaaacagattcacgtcagatttaac

SEQ ID NO: 239 - DNA, 66 bp, Zea mays
  source 1..66: mol_type = genomic DNA
ccagtactgcacgttacgtacgtacgaactaatatactccaccagctgatcactgatgagccgagc

SEQ ID NO: 240 - DNA, 66 bp, Zea mays
  source 1..66: mol_type = genomic DNA
gctcggctcatcagtgatcagctggtggagtatattagttcgtacgtacgtaacgtgcagtactgg

SEQ ID NO: 241 - DNA, 35 bp, Zea mays
  source 1..35: mol_type = genomic DNA
ccgacgtgcgtgcaacctcgaggccgcaaacagcc

SEQ ID NO: 242 - DNA, 35 bp, Zea mays
  source 1..35: mol_type = genomic DNA
ggctgtttgcggcctcgaggttgcacgcacgtcgg

SEQ ID NO: 243 - DNA, 68 bp, Zea mays
  source 1..68: mol_type = genomic DNA
gctcgtgttggagatacagggacagcaagtacttggcccttaactagcgaaggcgaggcggccatgga

SEQ ID NO: 244 - DNA, 68 bp, Zea mays
  source 1..68: mol_type = genomic DNA
tccatggccgcctcgccttcgctagttaagggccaagtacttgctgtccctgtatctccaacacgagc

SEQ ID NO: 245 - DNA, 1108 bp, synthetic construct
  misc_feature 1..1108: note = synthesized sequence- MHP14Cas-1 guideRNA cassette
  source 1..1108: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttaaatctgacgtgaatctgttgttttagagctagaaatagcaagttaaaataaggctagtccgttatcaacttgaaaaagtggcaccgagtcggtgcttttttttt

SEQ ID NO: 246 - DNA, 1106 bp, synthetic construct
  misc_feature 1..1106: note = synthesized sequence- MHP14Cas-3 gRNA cassette
  source 1..1106: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcaaacattgaagcgacataggttttagagctagaaatagcaagttaaaataaggctagtccgttatcaacttgaaaaagtggcaccgagtcggtgcttttttttt

SEQ ID NO: 247 - DNA, 1103 bp, synthetic construct
  misc_feature 1..1103: note = synthesized sequence- TS8Cas-1 guideRNA cassette
  source 1..1103: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtacgtaacgtgcagtacgttttagagctagaaatagcaagttaaaataaggctagtccgttatcaacttgaaaaagtggcaccgagtcggtgcttttttttt

SEQ ID NO: 248 - DNA, 1105 bp, synthetic construct
  misc_feature 1..1105: note = synthesized sequence- TS8Cas-2 guideRNA cassette
  source 1..1105: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgctcatcagtgatcagctgggttttagagctagaaatagcaagttaaaataaggctagtccgttatcaacttgaaaaagtggcaccgagtcggtgcttttttttt

SEQ ID NO: 249 - DNA, 1102 bp, synthetic construct
  misc_feature 1..1102: note = synthesized sequence- TS9Cas-2 guideRNA cassette
  source 1..1102: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattggctgtttgcggcctcggttttagagctagaaatagcaagttaaaataaggctagtccgttatcaacttgaaaaagtggcaccgagtcggtgcttttttttt

SEQ ID NO: 250 - DNA, 1106 bp, synthetic construct
  misc_feature 1..1106: note = synthesized sequence- TS9Cas-3 guideRNA cassette
  source 1..1106: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcctcgaggttgcacgcacgtgttttagagctagaaatagcaagttaaaataaggctagtccgttatcaacttgaaaaagtggcaccgagtcggtgcttttttttt

SEQ ID NO: 251 - DNA, 1105 bp, synthetic construct
  misc_feature 1..1105: note = synthesized sequence- TS10Cas-1 guideRNA cassette
  source 1..1105: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcctcgccttcgctagttaagttttagagctagaaatagcaagttaaaataaggctagtccgttatcaacttgaaaaagtggcaccgagtcggtgcttttttttt

SEQ ID NO: 252 - DNA, 1103 bp, synthetic construct
  misc_feature 1..1103: note = synthesized sequence- TSCas-3 guideRNA cassette
  source 1..1103: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgctcgtgttggagatacagttttagagctagaaatagcaagttaaaataaggctagtccgttatcaacttgaaaaagtggcaccgagtcggtgcttttttttt

SEQ ID NO: 253 - DNA, 4928 bp, synthetic construct
  misc_feature 1..4928: note = synthesized sequence- MHP14Cas1 donor
  source 1..4928: mol_type = other DNA
gccatgtcatcttgtagttagggcttggagctagtcgaccgttggaggctttgtcctcatgcggcaccggacagtctggtgctacaccggacagtccggtgcccctctgaccatctgctctgacatctgaattgcactgttcactttgcagagtcgaccattgcgtgcaggtagccattgctccgctggtgcaccggacagtccagtggcacaccggacagtccgatgaattatagcggagctgcgcctgggaaacccgaagctgaggagtttgagctgattcaccctggtgcaccggacactgtccggtggcacactggacagtccggtgcgccggaccagggcacacttcggtttcctttttgctcctttcttttgaagcctaacttgttcttttgattggtttgtgttgaacctttagcacctgtagaatgtatgatctagagcaaactagttagtccaattatttgtgttgggcaattcaaccaccaaaaacatttaggaaaatgtttgatcttatttccctttcatattctcttattgctagttgtcggggtgaagttgagctcttgcttaggttttaattagtgttgatttttagaaaaacccaattcacccccctcttgggcatcgtgatccttttagcaacaaaatgtgcacacatcaaaacaagcgcttctaccatatgtagttgttgcacaataatggtcctccttaggatttgcaaccgtttaacaatagctatgtgaccacagatttatgtcggatgcacgaaaattgtaggattttacatttctttaccttggttcacaaacattgaagcgacatagtggtgtatgaaaggaagcacttgtttttcaattccaaaccgcggtaccatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccagattcacgtcagatttaaccaaaactatattatgaggtacacatattacaatccaaaatgaattatctagttctcgagttgtacacagtttatcacgtgttttacacattccaaccctaaactccaaccgtgg

SEQ ID NO: 254 - DNA, 4570 bp, synthetic construct
  misc_feature 1..4570: note = synthesized sequence- MHP14Cas3 donor
  source 1..4570: mol_type = other DNA
acacttcggtttcctttttgctcctttcttttgaagcctaacttgttcttttgattggtttgtgttgaacctttagcacctgtagaatgtatgatctagagcaaactagttagtccaattatttgtgttgggcaattcaaccaccaaaaacatttaggaaaatgtttgatcttatttccctttcatattctcttattgctagttgtcggggtgaagttgagctcttgcttaggttttaattagtgttgatttttagaaaaacccaattcacccccctcttgggcatcgtgatccttttagcaacaaaatgtgcacacatcaaaacaagcgcttctaccatatgtagttgttgcacaataatggtcctccttaggatttgcaaccgtttaacaatagctatgtgaccacagatttatgtcggatgcacgaaaattgtaggattttacatttctttaccttggttcacaaacattgaagcgacaggtaccatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgcctagtggtgtatgaaaggaagcacttgtttttcaattccaaacagattcacgtcagatttaaccaaaactatattatgaggtacacatattacaatccaaaatgaattatctagttctcgagttgtacacagtttatcacgtgttttacacattccaaccctaaact

SEQ ID NO: 255 - DNA, 5091 bp, synthetic construct
  misc_feature 1..5091: note = synthesized sequence- TS8Cas-1 donor
  source 1..5091: mol_type = other DNA
cacacatgactgcctgagaatctgctgccgttgcctctcatattatattcgatcccctgactaaaaaaactcggggccggctaatacgtactgtacgtacgcagaatttacggtccagcacgggcatgccgcgcgggctgactttgctccactgactcgatcatgtgcggattccatcgcggcgtagcgtagccaaccgcaacgcaaaccgacttcatcttttttttttattatgaacaaaaggagatcgagagaaacgtgaacggtaaataatatatctgatcccatgcatgcacgctgcctgggtcgatctcgctctcgctccgcccagacgaacatgcatgctggtcaggctcaacgctcaggcgggcaagctgtgggaggacatgggatgggagaggaggacacatgcatgctggccagtcaggcactgtgctggcacatgaggtagggataggggggccctcggccagtgtccaggccgcatgcatgcatgccccccctgctgctcgaccgaacaacgttggatgcctggattgatgcaacagtttggacggacggaccatacgttatgtaccagtaggtaccatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcggactgcacgttacgtacgtacgaactaatatactccaccagctgatcactgatgagccgagccgccatgcattgtaatttataacatgtgcggctgtacgcttccatctcaaatacctttttatatatatattgtactttatagtctacgacataatctgccatggtaatttataagatgtgctttattgctcgttgttctgttctcatctgtgtccatggcatggcatggatacaaaatgtatgtatggccacgcatccaatctgtgacgttgtcaaggcagaggtccaaccgtccaagaccctcttgtgccgccctgtacttgcagtcagtgacgttgtgagaaaaagctgtgggtggtctccgcagagcgcgcgggccacgagagggagccccatctctcggccgaggggtacgggggctccagacacggtcctttggtttcttctgcctgtagcgagcggccccgccccccaccgcgctgctagcctagccgatgctgatccatccaccacccacaagggattgttccacgacttgtggacctgaccatgacgtgacttcacgccatgtacgctcagccgctcactagcttttttttc

SEQ ID NO: 256 - DNA, 5237 bp, synthetic construct
  misc_feature 1..5237: note = synthesized sequence- TS8Cas-2 donor
  source 1..5237: mol_type = other DNA
tctctttcagggcttgttcgtttacgttggattgcacccggaatcgttacagctaatcaaagtttatataaattagagaagcaaccggataggaatcgttccgacccaccaattcgacacaaacgaacaaggcctcaatccttctcaatccacctccaacccaataagctcttggaggcggcggcgggagagcagccacacacatgactgcctgagaatctgctgccgttgcctctcatattatattcgatcccctgactaaaaaaactcggggccggctaatacgtactgtacgtacgcagaatttacggtccagcacgggcatgccgcgcgggctgactttgctccactgactcgatcatgtgcggattccatcgcggcgtagcgtagccaaccgcaacgcaaaccgacttcatcttttttttttattatgaacaaaaggagatcgagagaaacgtgaacggtaaataatatatctgatcccatgcatgcacgctgcctgggtcgatctcgctctcgctccgcccagacgaacatgcatgctggtcaggctcaacgctcaggcgggcaagctgtgggaggacatgggatgggagaggaggacacatgcatgctggccagtcaggcactgtgctggcacatgaggtagggataggggggccctcggccagtgtccaggccgcatgcatgcatgccccccctgctgctcgaccgaacaacgttggatgcctggattgatgcaacagtttggacggacggaccatacgttatgtaccagtactgcacgttacgtacgtacgaactaatatactccaccaggtaccatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcgctgatcactgatgagccgagccgccatgcattgtaatttataacatgtgcggctgtacgcttccatctcaaatacctttttatatatatattgtactttatagtctacgacataatctgccatggtaatttataagatgtgctttattgctcgttgttctgttctcatctgtgtccatggcatggcatggatacaaaatgtatgtatggccacgcatccaatctgtgacgttgtcaaggcagaggtccaaccgtccaagaccctcttgtgccgccctgtacttgcagtcagtgacgttgtgagaaaaagctgtgggtggtctccgcagagcgcgcgggccacgagagggagccccatctctcggccgaggggtacgggggctccagacacggtcctttggtttcttctgcctgtagcgagcggccccgccccccaccgcgctgctagcctagccgatgctgatccatccaccacccacaagggattgttccacgacttgtggac

SEQ ID NO: 257 - DNA, 5427 bp, synthetic construct
  misc_feature 1..5427: note = synthesized sequence- TS9Cas-2 donor
  source 1..5427: mol_type = other DNA
agcaaggaactaaactgttattggacgctaaagtttagtactttatctttaacatctttcagcatttctatgtagatatttaagggctaaattttagcaagtgtgctgataaattttagcctaaatgtttctgttgggctaaattttagcaagtgtactgttaaattttagcatattccttttagagtggtatgggtgtgcatagactaaatgtttccgttgggccctaatttaacgatgtgtacgcaggcctgtttagatgacttggtaccggcatatggcctcgtactgtttcatttgatgacgcgagcgtgcggcccatgcagcagcagcacgccgggaaggcagcggattttgaagtactattggacagcgcggcgcggggaccgggtcgttggcgcgcggtggagtgggggtgggtggtcctggcgtcctgccctgcgcgatggtcgatggatgccccatgcgcgtgtaaccgcccagccgtcgccatccgaccaggtgggcagacgtacgtacggtggcacgcccacggcccatcggccatcgcgatcgcgttcgtatcgtgtcctcaataacgaaagcgccaacggaaggcgctgtcgtcgtcagttcaccgcgcgccggcgccctgtgtcctcgtccctctcgacttctcgaccagtaagaactctcgcgagctgcggagctgctggcgatggccggccggtgggatccgacgtgcgtgcaacctcgaatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggccgcaaacagcctggtgacagacgaagccagcaagcacgtacgtacgcacgtctctgctggtctggatgtgtatggatatggacgtctcacgtctggacgtcgtcgtcgccgttgtattgtatcatgccaaccacttccgtaccgtaccccctcgcgtgccaacatgaccaccgccggtacgtctccatcgtcggccgtcggcgtctcaggcagctctcaattaagcggacgtgttttggtaatctggtggaacgccgcgcgcactgagggtttgggggccccggcggacgagcgagcgagagacggtgcatgcatgccaaatggcaacgagggcccgcccgcccatccaataaccaacccagacgtagcgcaaccaacgtacgagtcctgtgctggcgcgtacgactaccacgctagctgccgcgacatgcgaactacggtccaccaggcaccagccatgacaatatatactgtatatatatttttcttcttctttttgtttccgctctctcaagttcctgctctgctcctgcctgtccgcggtgccgatcggcgagagagcatgcatggacatggaccacgcgagatccaggaaccggcacgggcccatgcgtggcaggcggccgtttcgtcaggttccccgaaatgccccaactgcgcggctgcaggatggctcatggctggctgcctagctggcccgtgacaccgatcgatcggtaacgacgacgcacgcacctgaagcacaggaaggagcctccctctcgcatgcacgttagtact

SEQ ID NO: 258 - DNA, 5426 bp, synthetic construct
  misc_feature 1..5426: note = synthesized sequence- TS9Cas-3 donor
  source 1..5426: mol_type = other DNA
agcaaggaactaaactgttattggacgcaaagtttagtactttatctttaacatctttcagcatttctatgtagatatttaagggctaaattttagcaagtgtgctgataaattttagcctaaatgtttctgttgggctaaattttagcaagtgtactgttaaattttagcatattccttttagagtggtatgggtgtgcatagactaaatgtttccgttgggccctaatttaacgatgtgtacgcaggcctgtttagatgacttggtaccggcatatggcctcgtactgtttcatttgatgacgcgagcgtgcggcccatgcagcagcagcacgccgggaaggcagcggattttgaagtactattggacagcgcggcgcggggaccgggtcgttggcgcgcggtggagtgggggtgggtggtcctggcgtcctgccctgcgcgatggtcgatggatgccccatgcgcgtgtaaccgcccagccgtcgccatccgaccaggtgggcagacgtacgtacggtggcacgcccacggcccatcggccatcgcgatcgcgttcgtatcgtgtcctcaataacgaaagcgccaacggaaggcgctgtcgtcgtcagttcaccgcgcgccggcgccctgtgtcctcgtccctctcgacttctcgaccagtaagaactctcgcgagctgcggagctgctggcgatggccggccggtgggatccgacgatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctctgcgtgcaacctcgaggccgcaaacagcctggtgacagacgaagccagcaagcacgtacgtacgcacgtctctgctggtctggatgtgtatggatatggacgtctcacgtctggacgtcgtcgtcgccgttgtattgtatcatgccaaccacttccgtaccgtaccccctcgcgtgccaacatgaccaccgccggtacgtctccatcgtcggccgtcggcgtctcaggcagctctcaattaagcggacgtgttttggtaatctggtggaacgccgcgcgcactgagggtttgggggccccggcggacgagcgagcgagagacggtgcatgcatgccaaatggcaacgagggcccgcccgcccatccaataaccaacccagacgtagcgcaaccaacgtacgagtcctgtgctggcgcgtacgactaccacgctagctgccgcgacatgcgaactacggtccaccaggcaccagccatgacaatatatactgtatatatatttttcttcttctttttgtttccgctctctcaagttcctgctctgctcctgcctgtccgcggtgccgatcggcgagagagcatgcatggacatggaccacgcgagatccaggaaccggcacgggcccatgcgtggcaggcggccgtttcgtcaggttccccgaaatgccccaactgcgcggctgcaggatggctcatggctggctgcctagctggcccgtgacaccgatcgatcggtaacgacgacgcacgcacctgaagcacaggaaggagcctccctctcgcatgcacgttagtact

SEQ ID NO: 259 - DNA, 5152 bp, synthetic construct
  misc_feature 1..5152: note = synthesized sequence- TS10Cas-1 donor
  source 1..5152: mol_type = other DNA
ggtaccaaatagtaaacgggaggggaggtcgctagtagtaaacgctaggtagctaggataatccgtctcgtgttggacggaaggttttggacgcatctgcgtgcacagcccgctgatacagatctgatcgactagctagctagatgccgaggccccagagcaaggcccggatactcctgcacagtccctgagatttcagcacagcaggtgctgttgcatcaatatataaatccctgctttattaatttaatctctgtgcatgtatccatacatcgtcagcggctcagcgctatcacactgcagtgcacgcagctagttgagcgcctgggtcagtatatatatagctagtagggacaaaggggggcactgtacgttggtttggtttggcacgcacgcgatcgagagtggtggaatggactgcagatcatcgatcgctgcactgtacgcacgcgcaccggactgcatttgcatgcccctgaaggaggaaaggggaaggaaagaaaagaaataggagaaagaagaagaagcagagaaatacgtcacagtccaagaagagtgagccgccctagctagcttcaaccctgacgaacccggcagccacacttccggccatgtatgcatgcatgcatggcttagcttcagatgtccaatcgaatccatcaagacctggccggttttccatggccgcctcgccttcgctagtggtaccatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgcctaagggccaagtacttgctgtccctgtatctccaacacgagccttgattcctgccggccggtgatggcaatggccgctagtagtctccgctagctagggagcggcgatccgacgcgacgccaccatgtgtctagaaaagaagtttcttgctttgcatgcagacttattagcgcggtcgacacctgtggggaccccgtgtcttgagacaatgagactgcctgtccgcccaagacactacttgtagccatgaagccatcgactcctctccttgctctccagtaatccagtggatggatccatcatcgatagtttagtttatcagtcttcttgaggccggtgtcccccatgcataatgatgacagaaagcctgggccaggtaaaagccaaaaagtttgaccctctaggtactggggccagccctggcgtttgaacaaaaaaaaaatctgagcgtgtcgccccggcctgttttcgaactcctaaacgacgtcgcaactttttttatacacacactaccggtacatggcttt

SEQ ID NO: 260 - DNA, 5146 bp, synthetic construct
  misc_feature 1..5146: note = synthesized sequence- TS10Cas-3 donor
  source 1..5146: mol_type = other DNA
aaatagtaaacgggaggggaggtcgctagtagtaaacgctaggtagctaggataatccgtctcgtgttggacggaaggttttggacgcatctgcgtgcacagcccgctgatacagatctgatcgactagctagctagatgccgaggccccagagcaaggcccggatactcctgcacagtccctgagatttcagcacagcaggtgctgttgcatcaatatataaatccctgctttattaatttaatctctgtgcatgtatccatacatcgtcagcggctcagcgctatcacactgcagtgcacgcagctagttgagcgcctgggtcagtatatatatagctagtagggacaaaggggggcactgtacgttggtttggtttggcacgcacgcgatcgagagtggtggaatggactgcagatcatcgatcgctgcactgtacgcacgcgcaccggactgcatttgcatgcccctgaaggaggaaaggggaaggaaagaaaagaaataggagaaagaagaagaagcagagaaatacgtcacagtccaagaagagtgagccgccctagctagcttcaaccctgacgaacccggcagccacacttccggccatgtatgcatgcatgcatggcttagcttcagatgtccaatcgaatccatcaagacctggccggttttccatggccgcctcgccttcgctagttaagggccaagtacttgctgtccctgtggtaccatttaaatcttaagcctaggataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcaattcgctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccatctccaacacgagccttgattcctgccggccggtgatggcaatggccgctagtagtctccgctagctagggagcggcgatccgacgcgacgccaccatgtgtctagaaaagaagtttcttgctttgcatgcagacttattagcgcggtcgacacctgtggggaccccgtgtcttgagacaatgagactgcctgtccgcccaagacactacttgtagccatgaagccatcgactcctctccttgctctccagtaatccagtggatggatccatcatcgatagtttagtttatcagtcttcttgaggccggtgtcccccatgcataatgatgacagaaagcctgggccaggtaaaagccaaaaagtttgaccctctaggtactggggccagccctggcgtttgaacaaaaaaaaaatctgagcgtgtcgccccggcctgttttcgaactcctaaacgacgtcgcaactttttttatacacacactaccggtacatggcttt

SEQ ID NO: 261 - DNA, 32 bp, synthetic construct; identical to SEQ ID NO: 100
  misc_feature 1..32: note = synthesized sequence- ubir primer from donor
  source 1..32: mol_type = other DNA

SEQ ID NO: 262 - DNA, 31 bp, synthetic construct; identical to SEQ ID NO: 99
  misc_feature 1..31: note = synthesized sequence- psbf primer from dono
  source 1..31: mol_type = other DNA

SEQ ID NO: 263 - DNA, 27 bp, synthetic construct
  misc_feature 1..27: note = synthesized sequence- MHP14 14-1HR1f primer
  source 1..27: mol_type = other DNA
ctcacatgaggctcttctttgcttgct

SEQ ID NO: 264 - DNA, 26 bp, synthetic construct
  misc_feature 1..26: note = synthesized sequence- MHP14 14-1HR2r primer
  source 1..26: mol_type = other DNA
aggatcctattccccaatttgtagat

SEQ ID NO: 265 - DNA, 21 bp, synthetic construct
  misc_feature 1..21: note = synthesized sequence- CHR1-8 8HR1f primer
  source 1..21: mol_type = other DNA
cagtccgtggattgaagccat

SEQ ID NO: 266 - DNA, 22 bp, synthetic construct
  misc_feature 1..22: note = synthesized sequence- CHR1-8 8HR2r primer
  source 1..22: mol_type = other DNA
ctctgtctccgagacgtgctta

SEQ ID NO: 267 - DNA, 26 bp, synthetic construct
  misc_feature 1..26: note = synthesized sequence- CHR1-9 9HR1f primer
  source 1..26: mol_type = other DNA
ggagcaaatgttttaggtatgaaatg

SEQ ID NO: 268 - DNA, 28 bp, synthetic construct
  misc_feature 1..28: note = synthesized sequence- CHR1-9 9HR2r primer
  source 1..28: mol_type = other DNA
cggattctaaagatcatacgtaaatgaa

SEQ ID NO: 269 - DNA, 21 bp, synthetic construct
  misc_feature 1..21: note = synthesized sequence- CHR1-10 10HR1f primer
  source 1..21: mol_type = other DNA
tggcttgtctatgcgcatctc

SEQ ID NO: 270 - DNA, 20 bp, synthetic construct
  misc_feature 1..20: note = synthesized sequence- CHR1-10 10HR2r primer
  source 1..20: mol_type = other DNA
ccagacccaaacagcaggtt

SEQ ID NO: 271 - DNA, 18 bp, synthetic construct
  misc_feature 1..18: note = synthesized sequence- MHP14Cas-1 probe
  source 1..18: mol_type = other DNA
cagattcacgtcagattt

SEQ ID NO: 272 - DNA, 27 bp, synthetic construct
  misc_feature 1..27: note = synthesized sequence- MHP14cas-1 forward primer
  source 1..27: mol_type = other DNA
catagtggtgtatgaaaggaagcactt

SEQ ID NO: 273 - DNA, 30 bp, synthetic construct
  misc_feature 1..30: note = synthesized sequence- MHP14cas-1 reverse primer
  source 1..30: mol_type = other DNA
cattttggattgtaatatgtgtacctcata

SEQ ID NO: 274 - DNA, 17 bp, synthetic construct
  misc_feature 1..17: note = synthesized sequence- MHP14Cas-3 probe
  source 1..17: mol_type = other DNA
caccactatgtcgcttc

SEQ ID NO: 275 - DNA, 22 bp, synthetic construct
  misc_feature 1..22: note = synthesized sequence- MHP14Cas-3 forward primer
  source 1..22: mol_type = other DNA
cggatgcacgaaaattgtagga

SEQ ID NO: 276 - DNA, 24 bp, synthetic construct
  misc_feature 1..24: note = synthesized sequence- MHP14Cas-3 reverse primer
  source 1..24: mol_type = other DNA
ctgacgtgaatctgtttggaattg

SEQ ID NO: 277 - DNA, 18 bp, synthetic construct
  misc_feature 1..18: note = synthesized sequence- TS8Cas-1 probe
  source 1..18: mol_type = other DNA
tacgtaacgtgcagtact

SEQ ID NO: 278 - DNA, 21 bp, synthetic construct
  misc_feature 1..21: note = synthesized sequence- TS8Cas-1 forward primer
  source 1..21: mol_type = other DNA
acggacggaccatacgttatg

SEQ ID NO: 279 - DNA, 26 bp, synthetic construct
  misc_feature 1..26: note = synthesized sequence- TS8Cas-1 reverse primer
  source 1..26: mol_type = other DNA
tcagctggtggagtatattagttcgt

SEQ ID NO: 280 - DNA, 18 bp, synthetic construct
  misc_feature 1..18: note = synthesized sequence- TS8Cas-2 probe
  source 1..18: mol_type = other DNA
ccagctgatcactgatga

SEQ ID NO: 281 - DNA, 21 bp, synthetic construct
  misc_feature 1..21: note = synthesized sequence- TS8Cas-2 forward primer
  source 1..21: mol_type = other DNA
acggacggaccatacgttatg

SEQ ID NO: 282 - DNA, 26 bp, synthetic construct
  misc_feature 1..26: note = synthesized sequence- TS8Cas-2 reverse primer
  source 1..26: mol_type = other DNA
cgcacatgttataaattacaatgcat

SEQ ID NO: 283 - DNA, 14 bp, synthetic construct
  misc_feature 1..14: note = synthesized sequence- TS9Cas-2 probe
  source 1..14: mol_type = other DNA
ctgtttgcggcctc

SEQ ID NO: 284 - DNA, 19 bp, synthetic construct
  misc_feature 1..19: note = synthesized sequence- TS9Cas-2 forward primer
  source 1..19: mol_type = other DNA
ctgcggagctgctggcgat

SEQ ID NO: 285 - DNA, 20 bp, synthetic construct
  misc_feature 1..20: note = synthesized sequence- TS9Cas-2 reverse primer
  source 1..20: mol_type = other DNA
cttgctggcttcgtctgtca

SEQ ID NO: 286 - DNA, 15 bp, synthetic construct
  misc_feature 1..15: note = synthesized sequence- TS9Cas-3 probe
  source 1..15: mol_type = other DNA
ccgacgtgcgtgcaa

SEQ ID NO: 287 - DNA, 19 bp, synthetic construct
  misc_feature 1..19: note = synthesized sequence- TS9Cas-3 forward primer
  source 1..19: mol_type = other DNA
ctgcggagctgctggcgat

SEQ ID NO: 288 - DNA, 20 bp, synthetic construct
  misc_feature 1..20: note = synthesized sequence- TS9Cas-3 reverse primer
  source 1..20: mol_type = other DNA
cttgctggcttcgtctgtca

SEQ ID NO: 289 - DNA, 17 bp, synthetic construct
  misc_feature 1..17: note = synthesized sequence- TS10Cas-1 probe
  source 1..17: mol_type = other DNA
tcgccttcgctagttaa

SEQ ID NO: 290 - DNA, 20 bp, synthetic construct
  misc_feature 1..20: note = synthesized sequence- TS10Cas-1 forward primer
  source 1..20: mol_type = other DNA
aagacctggccggttttcca

SEQ ID NO: 291 - DNA, 18 bp, synthetic construct
  misc_feature 1..18: note = synthesized sequence- TS10Cas-1 reverse primer
  source 1..18: mol_type = other DNA
tagcggccattgccatca

SEQ ID NO: 292 - DNA, 19 bp, synthetic construct
  misc_feature 1..19: note = synthesized sequence- TS10Cas-3 probe
  source 1..19: mol_type = other DNA
ctgtatctccaacacgagc

SEQ ID NO: 293 - DNA, 20 bp, synthetic construct
  misc_feature 1..20: note = synthesized sequence- TS10Cas-3 forward primer
  source 1..20: mol_type = other DNA
aagacctggccggttttcca

SEQ ID NO: 294 - DNA, 18 bp, synthetic construct
  misc_feature 1..18: note = synthesized sequence- TS10Cas-3 reverse primer
  source 1..18: mol_type = other DNA
tagcggccattgccatca

SEQ ID NO: 295 - DNA, 472 bp, Glycine max
  misc_feature 1..472: note = GM-U6-9.1 promoter
  source 1..472: mol_type = genomic DNA
cccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagctt

SEQ ID NO: 296 - DNA, 5958 bp, synthetic construct
  misc_feature 1..5958: note = synthesized sequence- EF1A2-CAS9
  source 1..5958: mol_type = other DNA
gggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 297 - DNA, 573 bp, synthetic construct
  misc_feature 1..573: note = synthesized sequence- U6-9.1-DD20CR1
  source 1..573: mol_type = other DNA
ccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagcttggaactgacacacgacatgagttttagagctagaaatagcaagttaaaataaggctagtccgttatcaacttgaaaaagtggcaccgagtcggtgctttttt

SEQ ID NO: 298 - DNA, 6611 bp, synthetic construct
  misc_feature 1..6611: note = synthesized sequence- U6-9.1-DD20CR1+EF1A2-CAS9
  source 1..6611: mol_type = other DNA
cgcgccggtacccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagcttggaactgacacacgacatgagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccgg

SEQ ID NO: 299 - DNA, 5686 bp, synthetic construct
  misc_feature 1..5686: note = synthesized sequence- DD20HR1-SAMS:HPT-DD20HR2
  source 1..5686: mol_type = other DNA
cgcgcctctagttgaagacacgttcatgtcttcatcgtaagaagacactcagtagtcttcggccagaatggccatctggattcagcaggcctagaaggccatttaaatcctgaggatctggtcttcctaaggacccgggatatcgctatcaactttgtatagaaaagttgggccgaattcgagctcggtacggccagaatccggtaagtgactagggtcacgtgaccctagtcacttaaattcggccagaatggccatctggattcagcaggcctagaaggcccggaccgattaaactttaattcggtccgggttacctcgagcctagtaataattacacatctaagatatccccttctttttcaagtaaaataatatcatatgatctcattttagtgaaacaatactatttccctgataactctcttcaacattagggacttcatctaatcatctactttcaaggtataactagacgtatttgttcttttaaaaaaaacactagatgtactcgtcaactcaaaattcatcgttcatgcattttaattaaactttaattagctaatgagtagaaaaagatcatacgagtaaaatagaagaatcttcctagattttggaagaatggattggagtgtaagtgaattgatccattagtggaagatgctctttacaatggccaaactgttctaattgttagagcacatttgagatgaaacacttcagtagtggaggtaacctacaatcctaggatctgtatcctctatcactaatggagcaatgggtttgagattgacttactcctttccttgtctctcgtagtgcatatgcgcactttcaaaggctacacaaaagccgttaactttttgtttatttaagttacgaaagatagttgaattagagtaaatggtgatattgaattaggattttaaataattttaaaagaatttttttaataaaaaaaatattgtgttgttggatcaaaatttttaaataacatgaataaggaaatggattgcaatgaggttttaaacaattattttaacatataggattttagaaagacttttataatattttgttgaagtttagattttaatatatttatgttttaaaattttaaaaaaaacttcatgaatttataatatttgaaaaagacacgtgaatatttagaaaacatttaaaattacaataataaatcataatgagatagggtgtattcatgtgtagacgagacaccaagtatatggttcacaagtgaatcatcttttttttttacagcacaagtagatcacttgtacttatcaaaattcggaactgacacacactagtggtcacctaagtgactagggtcacgtgaccctagtcacttattcccaaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccactagtccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgacccgggccctaggaggccggcccagctgatgatcccggtgaagttcctattccgaagttcctattctccagaaagtataggaacttcactagagcttgcggccgcgcatgctgacttaatcagctaacgccactcgacctgcaggcatgcccgcggatatcgatgggccccggccgaagcttcaagtttgtacaaaaaagcaggctggcgccggaaccaattcagtcgactggatccggtaccgaattcgcggccgcactcgagatatctagacccagctttcttgtacaaagtggccgttaacggatcggccagaatccggtaagtgactagggtcacgtgaccctagtcacttaaattcggccagaatggccatctggattcagcaggcctagaaggcccggaccgattaaactttaattcggtccgggttacctctagaaagcttgtcgacctgcagacacgacatgatggaacgtgactaaggtgggtttttgactttgcatgtcgaagtgagagtgattttattgagagaataatagaagacctacaaaacaaatgatcccgacgctaaagtaagtacgagagttaagagaataaatgggaaaatatgcatacatgattaggtgtgtgttcgtctcaagaaagtacgaatgaatatggtgtgtttgtagtacatgaatgatgtgttttgagggttcaagggaaattgatatttatagagtgaaatggaaccagaggtctttgttgacaagggttgttatgactcttgcaaataattaatagcttataaataatagccaataacttattatagatagagttagagataatatatagctaaatttgaacaaggcatacaaaacaaaaatgctaaatatgaataagacaatcaaaattgtagtcgatgttcaactctttgtcgttgaagaacttgtttgcagtggtatagtaaatgggtgtgagtgcagtgtctcacccatctcacaccacacaaccaacttcatatctaaagatattgtcgctgaatacaaaattgagttatggaatatacaattcataatatagatacgaaaaatcatttcttacaaaacattcaatcaaaaattattcaaacataattctagattaagtaatccgaagtacaagttagtatcctagatccgttaatttaaaattatgtttgcataattttggatttggtgttctataagggcacaattttgttcattcttacaagtttgtcaattctaaaatatatgcaaatttgaagaaaaaaaatttacgaatgtgtctcaaacaataacttaatgggaggagaatgagggatgaagaagctcaaaattaccaacgccttctacctcaagaagctacttcacacaaaatatgactggcggaaggataggggacaaccgataacgagaaggagatacataaggtaatgtacgttgttgtgtgagggatccggtcacctaagtgactagggtcacgtgaccctagtcacttattcccgggcaactttattatacaaagttgatagatctcgaattcattccgattaatcgtgg

SEQ ID NO: 300 - DNA, 6611 bp, synthetic construct
  misc_feature 1..6611: note = synthesized sequence- U6-9.1-DD20CR2+EF1A2-CAS9
  source 1..6611: mol_type = other DNA
cgcgccggtacccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagcttgacatgatggaacgtgactagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccgg

SEQ ID NO: 301 - DNA, 6611 bp, synthetic construct
  misc_feature 1..6611: note = synthesized sequence- U6-9.1:DD43CR1+EF1A2:CAS9
  source 1..6611: mol_type = other DNA
cgcgccggtacccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagcttgtcccttgtacttgtacgtagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccgg

SEQ ID NO: 302 - DNA, 5719 bp, synthetic construct
  misc_feature 1..5719: note = synthesized sequence- DD43HR1-SAMS:HPT-DD43HR2
  source 1..5719: mol_type = other DNA
cgcgcctctagttgaagacacgttcatgtcttcatcgtaagaagacactcagtagtcttcggccagaatggccatctggattcagcaggcctagaaggccatttaaatcctgaggatctggtcttcctaaggacccgggatatcgctatcaactttgtatagaaaagttgggccgaattcgagctcggtacggccagaatccggtaagtgactagggtcacgtgaccctagtcacttaaattcggccagaatggccatctggattcagcaggcctagaaggcccggaccgattaaactttaattcggtccgggttacctcgagatcttgttcccctccttggtttggcataaattgattttcatggctcttctcggtcgaaactggagctaattcacccttagtctctcttaaaattctggctgtaagaaacaccacagaacacataaattataaactaattataatttgaagagtaaaatatgtttttactcttatgatttaattagtgtagttttaattttctcctttttttaaaaaattttggtattcataaatttcaattttttaaaaataattgttgttacccgttaatgataacgggatatgttatgttaccactaaatcggacaaaaaaaattcaaaacttttataaggattaaaattaacaaaaatattttaaaaaaatctaacctcaataaagttaaatttataagcacaaaataatacttttaagcctaatttggcaagacacaagcaagctcacctgtagcattaatagaaaggaagcaaagcaagagaaaagcaaccagaaggaagcgtttgcttggtgacacagccatcttacttgaatttatggtattactgagaaaccttgatcttgcttcaaaatcttctagttaccctctttttataggcagaaagagaactagctagttgccaataggatatgaggacatgtggtgcaatgcactcactcttcaaggacaagaaaaacaatggctacaattgtggttcaaatcaatgtctcctgctctgtcctgcctgaaaatgacacccttttgcttggaaaagaggatcaaagctaagaacaggagtggcttcattcccttcatgtaaccaaacactttcgcattctgtcattcgtgaatcagcaaaatctgcaaccaaaaatatatggtgcctaaataaaagaaataaaataatttagagttgcggactaaaataataaacaaaagaaatatattataatctagaattaatttaggactaaaagaagaggcagactccaattcctcttttctagaataccctccgtacgtacactagtggtcacctaagtgactagggtcacgtgaccctagtcacttattcccaaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccactagtccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgacccgggccctaggaggccggcccagctgatgatcccggtgaagttcctattccgaagttcctattctccagaaagtataggaacttcactagagcttgcggccgcgcatgctgacttaatcagctaacgccactcgacctgcaggcatgcccgcggatatcgatgggccccggccgaagcttcaagtttgtacaaaaaagcaggctggcgccggaaccaattcagtcgactggatccggtaccgaattcgcggccgcactcgagatatctagacccagctttcttgtacaaagtggccgttaacggatcggccagaatccggtaagtgactagggtcacgtgaccctagtcacttaaattcggccagaatggccatctggattcagcaggcctagaaggcccggaccgattaaactttaattcggtccgggttacctctagaaagcttgtcgacctgcaggtacaagtacaagggacttgtgagttgtaaggctgtatttacaatagtgaaaagagaatcatctgggtgattgggtttttagtccccagtgacgaattaaaggtttgaattcttagtatgtttgggaatcaattaggaatttcgttttggactttccaaagcaattattcactttttcattcattaaatgtgactaaaaaattgttatttctccattggccaggatgcatcgtttatataaacataaccttagtgaaagcagtgttttcatgtgacagcggcagactatatcttaaacaaaattacttgtaaagaaagataccgttaggaaaaaaatgaaaagaaaattgaagctatcacttgtttactttcctaatatctttcaagaatacaatgtggtgaatttcaattttccctacatatgtataccgtcagcctgacgcaacttatgaaacttctctttctttcatttgatgtatatataaagacacattatatataaagaaactttatatatatctccatcatattttagtacttgctactatgtaaaattagctgttggaagtatctcaagaaacatttaatttattgaaccaagcattaaccattcatctacatttgagttctaaaataaatcttaaatgatgtggaggaagggaaattgttaattatttccctcttctcctacatggatatacctgaaacatgcaatggatggattagattttaacatttgcagcctgagaagttcactgactttcctccagctattttatgtgtgcccgccaccatttatagctcatgattgtagctgaactgcaaaaactgcatcgattgcaaactgaaattgagaatctcttttcaactttatatgctgattgatgcatgctgagcatgctatactagtactcgaagttcctatatgtagactttgttactgcctaatatactttgtgtttgttctcaagttcttattttatttcatattttttcctataaaaggttaatggctctataaaggttgagtgacggatccggtcacctaagtgactagggtcacgtgaccctagtcacttattcccgggcaactttattatacaaagttgatagatctcgaattcattccgattaatcgtgg

SEQ ID NO: 303 - DNA, 6611 bp, synthetic construct
  misc_feature 1..6611: note = synthesized sequence- U6-9.1:DD43CR2+EF1A2:CAS9
  source 1..6611: mol_type = other DNA
cgcgccggtacccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagcttgtattctagaaaagaggaatgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccgg

SEQ ID NO: 304 - DNA, 64 bp, synthetic construct
  misc_feature 1..64: note = synthesized sequence- DD20 qPCR amplicon
  source 1..64: mol_type = other DNA
attcggaactgacacacgacatgatggaacgtgactaaggtgggtttttgactttgcatgtcga

SEQ ID NO: 305 - DNA, 115 bp, synthetic construct
  misc_feature 1..115: note = synthesized sequence- DD43 qPCR amplicon
  source 1..115: mol_type = other DNA
aaagaagaggcagactccaattcctcttttctagaataccctccgtacgtacaagtacaagggacttgtgagttgtaaggctgtatttacaatagtgaaaagagaatcatctggg

SEQ ID NO: 306 - DNA, 20 bp, synthetic construct
  misc_feature 1..20: note = synthesized sequence- primer, DD20-CR1
  source 1..20: mol_type = other DNA
ggaactgacacacgacatga

SEQ ID NO: 307 - DNA, 20 bp, synthetic construct
  misc_feature 1..20: note = synthesized sequence- primer, DD20-CR2
  source 1..20: mol_type = other DNA
gacatgatggaacgtgacta

SEQ ID NO: 308 - DNA, 22 bp, synthetic construct
  misc_feature 1..22: note = synthesized sequence- primer, DD20-F
  source 1..22: mol_type = other DNA
attcggaactgacacacgacat

SEQ ID NO: 309 - DNA, 17 bp, synthetic construct
  misc_feature 1..17: note = synthesized sequence- FAM-MGB probe, DD20-T
  source 1..17: mol_type = other DNA
atggaacgtgactaagg

SEQ ID NO: 310 - DNA, 22 bp, synthetic construct
  misc_feature 1..22: note = synthesized sequence- primer, DD20-R
  source 1..22: mol_type = other DNA
tcgacatgcaaagtcaaaaacc

SEQ ID NO: 311 - DNA, 20 bp, synthetic construct
  misc_feature 1..20: note = synthesized sequence- primer, DD43CR1
  source 1..20: mol_type = other DNA
gtcccttgtacttgtacgta

SEQ ID NO: 312 - DNA, 20 bp, synthetic construct
  misc_feature 1..20: note = synthesized sequence- primer, DD43CR2
  source 1..20: mol_type = other DNA
gtattctagaaaagaggaat

SEQ ID NO: 313 - DNA, 26 bp, synthetic construct
  misc_feature 1..26: note = synthesized sequence- primer, DD43-F
  source 1..26: mol_type = other DNA
ttctagaataccctccgtacgtacaa

SEQ ID NO: 314 - DNA, 26 bp, synthetic construct
  misc_feature 1..26: note = synthesized sequence- primer, DD43-F2
  source 1..26: mol_type = other DNA
aaagaagaggcagactccaattcctc

SEQ ID NO: 315 - DNA, 19 bp, synthetic construct
  misc_feature 1..19: note = synthesized sequence- FAM-MGB probe, DD43-T
  source 1..19: mol_type = other DNA
caagggacttgtgagttgt

SEQ ID NO: 316 - DNA, 26 bp, synthetic construct
  misc_feature 1..26: note = synthesized sequence- primer, DD43-R
  source 1..26: mol_type = other DNA
cccagatgattctcttttcactattg

SEQ ID NO: 317 - DNA, 19 bp, synthetic construct
  misc_feature 1..19: note = synthesized sequence- primer, Cas9-F
  source 1..19: mol_type = other DNA
ccttcttccaccgccttga

SEQ ID NO: 318 - DNA, 19 bp, synthetic construct
  misc_feature 1..19: note = synthesized sequence- FAM-MGB probe, Cas9-T
  source 1..19: mol_type = other DNA
aatcattcctggtggagga

SEQ ID NO: 319 - DNA, 21 bp, synthetic construct
  misc_feature 1..21: note = synthesized sequence- primer, Cas9-R
  source 1..21: mol_type = other DNA
tgggtgtctctcgtgcttttt

SEQ ID NO: 320 - DNA, 22 bp, synthetic construct
  misc_feature 1..22: note = synthesized sequence- primer, Sams-76F
  source 1..22: mol_type = other DNA
aggcttgttgtgcagtttttga

SEQ ID NO: 321 - DNA, 22 bp, synthetic construct
  misc_feature 1..22: note = synthesized sequence- FAM-MGB probe, FRT1I-63T
  source 1..22: mol_type = other DNA
tggactagtggaagttcctata

SEQ ID NO: 322 - DNA, 21 bp, synthetic construct
  misc_feature 1..21: note = synthesized sequence- primer, FRT1I-41F
  source 1..21: mol_type = other DNA
gcggtgagttcaggctttttc

SEQ ID NO: 323 - DNA, 31 bp, synthetic construct
  misc_feature 1..31: note = synthesized sequence- primer, DD20-LB
  source 1..31: mol_type = other DNA
ggttataccttcttcttagtgtggtctatcc

SEQ ID NO: 324 - DNA, 31 bp, synthetic construct
  misc_feature 1..31: note = synthesized sequence- primer, Sams-A1
  source 1..31: mol_type = other DNA
cccaaaataattagtatgattggtaaggaag

SEQ ID NO: 325 - DNA, 23 bp, synthetic construct
  misc_feature 1..23: note = synthesized sequence- primer, QC498A-S1
  source 1..23: mol_type = other DNA
ggaacttcactagagcttgcggc

SEQ ID NO: 326 - DNA, 28 bp, synthetic construct
  misc_feature 1..28: note = synthesized sequence- primer, DD20-RB
  source 1..28: mol_type = other DNA
gccattacattcttcataagttcctctc

SEQ ID NO: 327 - DNA, 26 bp, synthetic construct
  misc_feature 1..26: note = synthesized sequence- primer, DD43-LB
  source 1..26: mol_type = other DNA
gtgtagtccattgtagccaagtcacc

SEQ ID NO: 328 - DNA, 24 bp, synthetic construct
  misc_feature 1..24: note = synthesized sequence- primer, DD43-RB
  source 1..24: mol_type = other DNA
caaaccggagagagaggaagaacc

SEQ ID NO: 329 - DNA, 2105 bp, synthetic construct
  misc_feature 1..2105: note = synthesized sequence- DD20 HR1-HR2 PCR amplicon
  source 1..2105: mol_type = other DNA
ggttataccttcttcttagtgtggtctatcccctagtaataattacacatctaagatatccccttctttttcaagtaaaataatatcatatgatctcattttagtgaaacaatactatttccctgataactctcttcaacattagggacttcatctaatcatctactttcaaggtataactagacgtatttgttcttttaaaaaaaacactagatgtactcgtcaactcaaaattcatcgttcatgcattttaattaaactttaattagctaatgagtagaaaaagatcatacgagtaaaatagaagaatcttcctagattttggaagaatggattggagtgtaagtgaattgatccattagtggaagatgctctttacaatggccaaactgttctaattgttagagcacatttgagatgaaacacttcagtagtggaggtaacctacaatcctaggatctgtatcctctatcactaatggagcaatgggtttgagattgacttactcctttccttgtctctcgtagtgcatatgcgcactttcaaaggctacacaaaagccgttaactttttgtttatttaagttacgaaagatagttgaattagagtaaatggtgatattgaattaggattttaaataattttaaaagaatttttttaataaaaaaaatattgtgttgttggatcaaaatttttaaataacatgaataaggaaatggattgcaatgaggttttaaacaattattttaacatataggattttagaaagacttttataatattttgttgaagtttagattttaatatatttatgttttaaaattttaaaaaaaacttcatgaatttataatatttgaaaaagacacgtgaatatttagaaaacatttaaaattacaataataaatcataatgagatagggtgtattcatgtgtagacgagacaccaagtatatggttcacaagtgaatcatcttttttttttacagcacaagtagatcacttgtacttatcaaaattcggaactgacacacgacatgatggaacgtgactaaggtgggtttttgactttgcatgtcgaagtgagagtgattttattgagagaataatagaagacctacaaaacaaatgatcccgacgctaaagtaagtacgagagttaagagaataaatgggaaaatatgcatacatgattaggtgtgtgttcgtctcaagaaagtacgaatgaatatggtgtgtttgtagtacatgaatgatgtgttttgagggttcaagggaaattgatatttatagagtgaaatggaaccagaggtctttgttgacaagggttgttatgactcttgcaaataattaatagcttataaataatagccaataacttattatagatagagttagagataatatatagctaaatttgaacaaggcatacaaaacaaaaatgctaaatatgaataagacaatcaaaattgtagtcgatgttcaactctttgtcgttgaagaacttgtttgcagtggtatagtaaatgggtgtgagtgcagtgtctcacccatctcacaccacacaaccaacttcatatctaaagatattgtcgctgaatacaaaattgagttatggaatatacaattcataatatagatacgaaaaatcatttcttacaaaacattcaatcaaaaattattcaaacataattctagattaagtaatccgaagtacaagttagtatcctagatccgttaatttaaaattatgtttgcataattttggatttggtgttctataagggcacaattttgttcattcttacaagtttgtcaattctaaaatatatgcaaatttgaagaaaaaaaatttacgaatgtgtctcaaacaataacttaatgggaggagaatgagggatgaagaagctcaaaattaccaacgccttctacctcaagaagctacttcacacaaaatatgactggcggaaggataggggacaaccgataacgagaaggagatacataaggtaatgtacgttgttgtgtgaggtacacaattatggggatgaagaagttcaactttagtcgaaaaaatgtttgagaggaacttatgaagaatgtaatggc

SEQ ID NO: 330 - DNA, 1204 bp, synthetic construct
  misc_feature 1..1204: note = synthesized sequence- DD20 HR1-SAMS PCR amplicon
  source 1..1204: mol_type = other DNA
ggttataccttcttcttagtgtggtctatcccctagtaataattacacatctaagatatccccttctttttcaagtaaaataatatcatatgatctcattttagtgaaacaatactatttccctgataactctcttcaacattagggacttcatctaatcatctactttcaaggtataactagacgtatttgttcttttaaaaaaaacactagatgtactcgtcaactcaaaattcatcgttcatgcattttaattaaactttaattagctaatgagtagaaaaagatcatacgagtaaaatagaagaatcttcctagattttggaagaatggattggagtgtaagtgaattgatccattagtggaagatgctctttacaatggccaaactgttctaattgttagagcacatttgagatgaaacacttcagtagtggaggtaacctacaatcctaggatctgtatcctctatcactaatggagcaatgggtttgagattgacttactcctttccttgtctctcgtagtgcatatgcgcactttcaaaggctacacaaaagccgttaactttttgtttatttaagttacgaaagatagttgaattagagtaaatggtgatattgaattaggattttaaataattttaaaagaatttttttaataaaaaaaatattgtgttgttggatcaaaatttttaaataacatgaataaggaaatggattgcaatgaggttttaaacaattattttaacatataggattttagaaagacttttataatattttgttgaagtttagattttaatatatttatgttttaaaattttaaaaaaaacttcatgaatttataatatttgaaaaagacacgtgaatatttagaaaacatttaaaattacaataataaatcataatgagatagggtgtattcatgtgtagacgagacaccaagtatatggttcacaagtgaatcatcttttttttttacagcacaagtagatcacttgtacttatcaaaattcggaactgacacacactagtggtcacctaagtgactagggtcacgtgaccctagtcacttattcccaaacactagtaacggccgccagtgtgctggaattcgcccttcccaagctttgctctagatcaaactcacatccaaacataacatggatatcttccttaccaatcatactaattattttggg

SEQ ID NO: 331 - DNA, 1459 bp, synthetic construct
  misc_feature 1..1459: note = synthesized sequence- DD20 NOS-HR2 PCR amplicon
  source 1..1459: mol_type = other DNA
ggaacttcactagagcttgcggccgcgcatgctgacttaatcagctaacgccactcgacctgcaggcatgcccgcggatatcgatgggccccggccgaagcttcaagtttgtacaaaaaagcaggctggcgccggaaccaattcagtcgactggatccggtaccgaattcgcggccgcactcgagatatctagacccagctttcttgtacaaagtggccgttaacggatcggccagaatccggtaagtgactagggtcacgtgaccctagtcacttaaattcggccagaatggccatctggattcagcaggcctagaaggcccggaccgattaaactttaattcggtccgggttacctctagaaagcttgtcgacctgcagacacgacatgatggaacgtgactaaggtgggtttttgactttgcatgtcgaagtgagagtgattttattgagagaataatagaagacctacaaaacaaatgatcccgacgctaaagtaagtacgagagttaagagaataaatgggaaaatatgcatacatgattaggtgtgtgttcgtctcaagaaagtacgaatgaatatggtgtgtttgtagtacatgaatgatgtgttttgagggttcaagggaaattgatatttatagagtgaaatggaaccagaggtctttgttgacaagggttgttatgactcttgcaaataattaatagcttataaataatagccaataacttattatagatagagttagagataatatatagctaaatttgaacaaggcatacaaaacaaaaatgctaaatatgaataagacaatcaaaattgtagtcgatgttcaactctttgtcgttgaagaacttgtttgcagtggtatagtaaatgggtgtgagtgcagtgtctcacccatctcacaccacacaaccaacttcatatctaaagatattgtcgctgaatacaaaattgagttatggaatatacaattcataatatagatacgaaaaatcatttcttacaaaacattcaatcaaaaattattcaaacataattctagattaagtaatccgaagtacaagttagtatcctagatccgttaatttaaaattatgtttgcataattttggatttggtgttctataagggcacaattttgttcattcttacaagtttgtcaattctaaaatatatgcaaatttgaagaaaaaaaatttacgaatgtgtctcaaacaataacttaatgggaggagaatgagggatgaagaagctcaaaattaccaacgccttctacctcaagaagctacttcacacaaaatatgactggcggaaggataggggacaaccgataacgagaaggagatacataaggtaatgtacgttgttgtgtgaggtacacaattatggggatgaagaagttcaactttagtcgaaaaaatgtttgagaggaacttatgaagaatgtaatggc

SEQ ID NO: 332 - DNA, 2098 bp, synthetic construct
  misc_feature 1..2098: note = synthesized sequence- DD43 HR1-HR2 PCR amplicon
  source 1..2098: mol_type = other DNA
gtgtagtccattgtagccaagtcaccaatatcttgttcccctccttggtttggcataaattgattttcatggctcttctcggtcgaaactggagctaattcacccttagtctctcttaaaattctggctgtaagaaacaccacagaacacataaattataaactaattataatttgaagagtaaaatatgtttttactcttatgatttaattagtgtagttttaattttctcctttttttaaaaaattttggtattcataaatttcaattttttaaaaataattgttgttacccgttaatgataacgggatatgttatgttaccactaaatcggacaaaaaaaattcaaaacttttataaggattaaaattaacaaaaatattttaaaaaaatctaacctcaataaagttaaatttataagcacaaaataatacttttaagcctaatttggcaagacacaagcaagctcacctgtagcattaatagaaaggaagcaaagcaagagaaaagcaaccagaaggaagcgtttgcttggtgacacagccatcttacttgaatttatggtattactgagaaaccttgatcttgcttcaaaatcttctagttaccctctttttataggcagaaagagaactagctagttgccaataggatatgaggacatgtggtgcaatgcactcactcttcaaggacaagaaaaacaatggctacaattgtggttcaaatcaatgtctcctgctctgtcctgcctgaaaatgacacccttttgcttggaaaagaggatcaaagctaagaacaggagtggcttcattcccttcatgtaaccaaacactttcgcattctgtcattcgtgaatcagcaaaatctgcaaccaaaaatatatggtgcctaaataaaagaaataaaataatttagagttgcggactaaaataataaacaaaagaaatatattataatctagaattaatttaggactaaaagaagaggcagactccaattcctcttttctagaataccctccgtacgtacaagtacaagggacttgtgagttgtaaggctgtatttacaatagtgaaaagagaatcatctgggtgattgggtttttagtccccagtgacgaattaaaggtttgaattcttagtatgtttgggaatcaattaggaatttcgttttggactttccaaagcaattattcactttttcattcattaaatgtgactaaaaaattgttatttctccattggccaggatgcatcgtttatataaacataaccttagtgaaagcagtgttttcatgtgacagcggcagactatatcttaaacaaaattacttgtaaagaaagataccgttaggaaaaaaatgaaaagaaaattgaagctatcacttgtttactttcctaatatctttcaagaatacaatgtggtgaatttcaattttccctacatatgtataccgtcagcctgacgcaacttatgaaacttctctttctttcatttgatgtatatataaagacacattatatataaagaaactttatatatatctccatcatattttagtacttgctactatgtaaaattagctgttggaagtatctcaagaaacatttaatttattgaaccaagcattaaccattcatctacatttgagttctaaaataaatcttaaatgatgtggaggaagggaaattgttaattatttccctcttctcctacatggatatacctgaaacatgcaatggatggattagattttaacatttgcagcctgagaagttcactgactttcctccagctattttatgtgtgcccgccaccatttatagctcatgattgtagctgaactgcaaaaactgcatcgattgcaaactgaaattgagaatctcttttcaactttatatgctgattgatgcatgctgagcatgctatactagtactcgaagttcctatatgtagactttgttactgcctaatatactttgtgtttgttctcaagttcttattttatttcatattttttcctataaaaggttaatggctctataaaggttgagtgacatatatatactataaaggttcttcctctctctccggtttg

SEQ ID NO: 333 - DNA, 1202 bp, synthetic construct
  misc_feature 1..1202: note = synthesized sequence- DD43 HR1-SAMS PCR PCR amplicon
  source 1..1202: mol_type = other DNA
gtgtagtccattgtagccaagtcaccaatatcttgttcccctccttggtttggcataaattgattttcatggctcttctcggtcgaaactggagctaattcacccttagtctctcttaaaattctggctgtaagaaacaccacagaacacataaattataaactaattataatttgaagagtaaaatatgtttttactcttatgatttaattagtgtagttttaattttctcctttttttaaaaaattttggtattcataaatttcaattttttaaaaataattgttgttacccgttaatgataacgggatatgttatgttaccactaaatcggacaaaaaaaattcaaaacttttataaggattaaaattaacaaaaatattttaaaaaaatctaacctcaataaagttaaatttataagcacaaaataatacttttaagcctaatttggcaagacacaagcaagctcacctgtagcattaatagaaaggaagcaaagcaagagaaaagcaaccagaaggaagcgtttgcttggtgacacagccatcttacttgaatttatggtattactgagaaaccttgatcttgcttcaaaatcttctagttaccctctttttataggcagaaagagaactagctagttgccaataggatatgaggacatgtggtgcaatgcactcactcttcaaggacaagaaaaacaatggctacaattgtggttcaaatcaatgtctcctgctctgtcctgcctgaaaatgacacccttttgcttggaaaagaggatcaaagctaagaacaggagtggcttcattcccttcatgtaaccaaacactttcgcattctgtcattcgtgaatcagcaaaatctgcaaccaaaaatatatggtgcctaaataaaagaaataaaataatttagagttgcggactaaaataataaacaaaagaaatatattataatctagaattaatttaggactaaaagaagaggcagactccaattcctcttttctagaataccctccgtacgtacactagtggtcacctaagtgactagggtcacgtgaccctagtcacttattcccaaacactagtaacggccgccagtgtgctggaattcgcccttcccaagctttgctctagatcaaactcacatccaaacataacatggatatcttccttaccaatcatactaattattttggg

SEQ ID NO: 334 - DNA, 1454 bp, synthetic construct
  misc_feature 1..1454: note = synthesized sequence- DD43 NOS-HR2 PCR PCR amplicon
  source 1..1454: mol_type = other DNA
ggaacttcactagagcttgcggccgcgcatgctgacttaatcagctaacgccactcgacctgcaggcatgcccgcggatatcgatgggccccggccgaagcttcaagtttgtacaaaaaagcaggctggcgccggaaccaattcagtcgactggatccggtaccgaattcgcggccgcactcgagatatctagacccagctttcttgtacaaagtggccgttaacggatcggccagaatccggtaagtgactagggtcacgtgaccctagtcacttaaattcggccagaatggccatctggattcagcaggcctagaaggcccggaccgattaaactttaattcggtccgggttacctctagaaagcttgtcgacctgcaggtacaagtacaagggacttgtgagttgtaaggctgtatttacaatagtgaaaagagaatcatctgggtgattgggtttttagtccccagtgacgaattaaaggtttgaattcttagtatgtttgggaatcaattaggaatttcgttttggactttccaaagcaattattcactttttcattcattaaatgtgactaaaaaattgttatttctccattggccaggatgcatcgtttatataaacataaccttagtgaaagcagtgttttcatgtgacagcggcagactatatcttaaacaaaattacttgtaaagaaagataccgttaggaaaaaaatgaaaagaaaattgaagctatcacttgtttactttcctaatatctttcaagaatacaatgtggtgaatttcaattttccctacatatgtataccgtcagcctgacgcaacttatgaaacttctctttctttcatttgatgtatatataaagacacattatatataaagaaactttatatatatctccatcatattttagtacttgctactatgtaaaattagctgttggaagtatctcaagaaacatttaatttattgaaccaagcattaaccattcatctacatttgagttctaaaataaatcttaaatgatgtggaggaagggaaattgttaattatttccctcttctcctacatggatatacctgaaacatgcaatggatggattagattttaacatttgcagcctgagaagttcactgactttcctccagctattttatgtgtgcccgccaccatttatagctcatgattgtagctgaactgcaaaaactgcatcgattgcaaactgaaattgagaatctcttttcaactttatatgctgattgatgcatgctgagcatgctatactagtactcgaagttcctatatgtagactttgttactgcctaatatactttgtgtttgttctcaagttcttattttatttcatattttttcctataaaaggttaatggctctataaaggttgagtgacatatatatactataaaggttcttcctctctctccggtttg

SEQ ID NO: 335 - DNA, 60 bp, Glycine max
  misc_feature 1..60: note = soybean genomic DD20CR1 target region
  source 1..60: mol_type = genomic DNA
acttgtacttatcaaaattcggaactgacacacgacatgatggaacgtgactaaggtggg

SEQ ID NO: 336 - DNA, 59 bp, Glycine max
  source 1..59: mol_type = genomic DNA
acttgtacttatcaaaattcggaactgacacacgactgatggaacgtgactaaggtggg

SEQ ID NO: 337 - DNA, 59 bp, Glycine max
  source 1..59: mol_type = genomic DNA
acttgtacttatcaaaattcggaactgacacacgaatgatggaacgtgactaaggtggg

SEQ ID NO: 338 - DNA, 58 bp, Glycine max
  source 1..58: mol_type = genomic DNA
acttgtacttatcaaaattcggaactgacacacgatgatggaacgtgactaaggtggg

SEQ ID NO: 339 - DNA, 58 bp, Glycine max
  source 1..58: mol_type = genomic DNA
acttgtacttatcaaaattcggaactgacacacgacgatggaacgtgactaaggtggg

SEQ ID NO: 340 - DNA, 58 bp, Glycine max
  source 1..58: mol_type = genomic DNA
acttgtacttatcaaaattcggaactgacacacggtgatggaacgtgactaaggtggg

SEQ ID NO: 341 - DNA, 57 bp, Glycine max
  source 1..57: mol_type = genomic DNA
acttgtacttatcaaaattcggaactgacacacatgatggaacgtgactaaggtggg

SEQ ID NO: 342 - DNA, 57 bp, Glycine max
  source 1..57: mol_type = genomic DNA
acttgtacttatcaaaattcggaactgacacacgtgatggaacgtgactaaggtggg

SEQ ID NO: 343 - DNA, 56 bp, Glycine max
  source 1..56: mol_type = genomic DNA
acttgtacttatcaaaattcggaactgacacactgatggaacgtgactaaggtggg

SEQ ID NO: 344 - DNA, 56 bp, Glycine max
  source 1..56: mol_type = genomic DNA
acttgtacttatcaaaattcggaactgacacacggatggaacgtgactaaggtggg

SEQ ID NO: 345 - DNA, 55 bp, Glycine max
  source 1..55: mol_type = genomic DNA
acttgtacttatcaaaattcggaactgacacacgatggaacgtgactaaggtggg

SEQ ID NO: 346 - DNA, 55 bp, Glycine max
  source 1..55: mol_type = genomic DNA
acttgtacttatcaaaattcggaactgacacatgatggaacgtgactaaggtggg

SEQ ID NO: 347 - DNA, 54 bp, Glycine max
  source 1..54: mol_type = genomic DNA
acttgtacttatcaaaattcggaactgacacacatggaacgtgactaaggtggg

SEQ ID NO: 348 - DNA, 54 bp, Glycine max
  source 1..54: mol_type = genomic DNA
acttgtacttatcaaaattcggaactgacactgatggaacgtgactaaggtggg

SEQ ID NO: 349 - DNA, 53 bp, Glycine max
  source 1..53: mol_type = genomic DNA
acttgtacttatcaaaattcggaactgacacgatggaacgtgactaaggtggg

SEQ ID NO: 350 - DNA, 51 bp, Glycine max
  source 1..51: mol_type = genomic DNA
acttgtacttatcaaaattcggaactgatgatggaacgtgactaaggtggg

SEQ ID NO: 351 - DNA, 50 bp, Glycine max
  source 1..50: mol_type = genomic DNA
acttgtacttatcaaaattcggaactgacatggaacgtgactaaggtggg

SEQ ID NO: 352 - DNA, 50 bp, Glycine max
  source 1..50: mol_type = genomic DNA
acttgtacttatcaaaattcggaactgtgatggaacgtgactaaggtggg

SEQ ID NO: 353 - DNA, 51 bp, Glycine max
  source 1..51: mol_type = genomic DNA
acttgtacttatcaaaattcggaactgacacacgaacgtgactaaggtggg

SEQ ID NO: 354 - DNA, 50 bp, Glycine max
  source 1..50: mol_type = genomic DNA
acttgtacttatcaaaattcggaactgacacggaacgtgactaaggtggg

SEQ ID NO: 355 - DNA, 49 bp, Glycine max
  source 1..49: mol_type = genomic DNA
acttgtacctatcaaaattcggaactgaatggaacgtgactaaggtggg

SEQ ID NO: 356 - DNA, 48 bp, Glycine max
  source 1..48: mol_type = genomic DNA
acttgtacttatcaaaattcggaactgatggaacgtgactaaggtggg

SEQ ID NO: 357 - DNA, 46 bp, Glycine max
  source 1..46: mol_type = genomic DNA
acttgtacttatcaaaattcggaactgagaacgtgactaaggtggg

SEQ ID NO: 358 - DNA, 38 bp, Glycine max
  source 1..38: mol_type = genomic DNA
acttgtacttatcaaaattcggaactgacacacgacat

SEQ ID NO: 359 - DNA, 38 bp, Glycine max
  source 1..38: mol_type = genomic DNA
acttgtacttatcaaaattcggaactgacaaaggtggg

SEQ ID NO: 360 - DNA, 39 bp, Glycine max
  source 1..39: mol_type = genomic DNA
acttgtacttatcaaaattcggaacgtgactaaggtggg

SEQ ID NO: 361 - DNA, 24 bp, Glycine max
  source 1..24: mol_type = genomic DNA
actatggaacgtgactaaggtggg

SEQ ID NO: 362 - DNA, 211 bp, Glycine max
  source 1..211: mol_type = genomic DNA
acttgtacttatcaaaattcggaactgacacacggccggtgatggattggtggatgagtgttgcgtcgagcacctccttggtggaggtgtatctcttcctgtcaatggtggtgtcgaagtacttgaaggcagcaggggctcccaagtttgtgagggtaaacaggtggataatgttttcagcctgctcgcgatggaacgtgactaaggtggg

SEQ ID NO: 363 - DNA, 90 bp, Glycine max
  source 1..90: mol_type = genomic DNA
acttgtacttatcaaaaactacttgtgctgtaaaaaaaaagaggaacaatcttcactcatcaataagtgatggaacgcgactaaggtggg

SEQ ID NO: 364 - DNA, 57 bp, Glycine max
  misc_feature 1..57: note = soybean genomic DD20CR2 target region
  source 1..57: mol_type = genomic DNA
gacacacgacatgatggaacgtgactaaggtgggtttttgactttgcatgtcgaagt

SEQ ID NO: 365 - DNA, 61 bp, Glycine max
  source 1..61: mol_type = genomic DNA
actgacacacgacatgatggaacgtgaactaaggtgggtttttgactttgcatgtcgaagt

SEQ ID NO: 366 - DNA, 59 bp, Glycine max
  source 1..59: mol_type = genomic DNA
actgacacacgacatgatggaacgtactaaggtgggtttttgactttgcatgtcgaagt

SEQ ID NO: 367 - DNA, 58 bp, Glycine max
  source 1..58: mol_type = genomic DNA
actgacacacgacatgatggaacgtctaaggtgggtttttgactttgcatgtcgaagt

SEQ ID NO: 368 - DNA, 58 bp, Glycine max
  source 1..58: mol_type = genomic DNA
actgacacacgacatgatggaacgtgaaaggtgggtttttgactttgcatgtcgaagt

SEQ ID NO: 369 - DNA, 57 bp, Glycine max
  source 1..57: mol_type = genomic DNA
actgacacacgacatgatggaacgctaaggtgggtttttgactttgcatgtcgaagt

SEQ ID NO: 370 - DNA, 57 bp, Glycine max
  source 1..57: mol_type = genomic DNA
actgacacacgacatgatggaacgtgaaggtgggtttttgactttgcatgtcgaagt

SEQ ID NO: 371 - DNA, 56 bp, Glycine max
  source 1..56: mol_type = genomic DNA
actgacacacgacatgatggaacgtgaggtgggtttttgactttgcatgtcgaagt

SEQ ID NO: 372 - DNA, 56 bp, Glycine max
  source 1..56: mol_type = genomic DNA
actgacacacgacatgatggaacgtaaggtgggtttttgactttgcatgtcgaagt

SEQ ID NO: 373 - DNA, 56 bp, Glycine max
  source 1..56: mol_type = genomic DNA
actgacacacgacatgatggaacctaaggtgggtttttgactttgcatgtcgaagt

SEQ ID NO: 374 - DNA, 56 bp, Glycine max; identical to SEQ ID NO: 371
  source 1..56: mol_type = genomic DNA

SEQ ID NO: 375 - DNA, 55 bp, Glycine max
  source 1..55: mol_type = genomic DNA
actgacacacgacatgatggaactaaggtgggtttttgactttgcatgtcgaagt

SEQ ID NO: 376 - DNA, 54 bp, Glycine max
  source 1..54: mol_type = genomic DNA
actgacacacgacatgatggaataaggtgggtttttgactttgcatgtcgaagt

SEQ ID NO: 377 - DNA, 53 bp, Glycine max
  source 1..53: mol_type = genomic DNA
actgacacacgacatgatggctaaggtgggtttttgactttgcatgtcgaagt

SEQ ID NO: 378 - DNA, 53 bp, Glycine max
  source 1..53: mol_type = genomic DNA
actgacacacgacatgatggataaggtgggtttttgactttgcatgtcgaagt

SEQ ID NO: 379 - DNA, 51 bp, Glycine max
  source 1..51: mol_type = genomic DNA
actgacacacgacatgatggaaggtgggtttttgactttgcatgtcgaagt

SEQ ID NO: 380 - DNA, 50 bp, Glycine max
  source 1..50: mol_type = genomic DNA
actgacacacgacatgatggaggtgggtttttgactttgcatgtcgaagt

SEQ ID NO: 381 - DNA, 44 bp, Glycine max
  source 1..44: mol_type = genomic DNA
actgacacacgacatgatgggtttttgactttgcatgtcgaagt

SEQ ID NO: 382 - DNA, 43 bp, Glycine max
  source 1..43: mol_type = genomic DNA
actgacacacgacaggtgggtttttgactttgcatgtcgaagt

SEQ ID NO: 383 - DNA, 40 bp, Glycine max
  source 1..40: mol_type = genomic DNA
actgacactaaggtgggtttttgactttgcatgtcgaagt

SEQ ID NO: 384 - DNA, 25 bp, Glycine max
  source 1..25: mol_type = genomic DNA
actgacacacgacatgatggaacgt

SEQ ID NO: 385 - DNA, 20 bp, Glycine max
  source 1..20: mol_type = genomic DNA
actgacacacgacatgatgg

SEQ ID NO: 386 - DNA, 60 bp, Glycine max
  misc_feature 1..60: note = soybean genomic DD43CR1 target region
  source 1..60: mol_type = genomic DNA
agccttacaactcacaagtcccttgtacttgtacgtacggagggtattctagaaaagagg

SEQ ID NO: 387 - DNA, 59 bp, Glycine max
  source 1..59: mol_type = genomic DNA
agccttacaactcacaagtcccttgtacttgtactacggagggtattctagaaaagagg

SEQ ID NO: 388 - DNA, 59 bp, Glycine max
  source 1..59: mol_type = genomic DNA
agccttacaactcacaagtcccttgtacttgtagtacggagggtattctagaaaagagg

SEQ ID NO: 389 - DNA, 58 bp, Glycine max
  source 1..58: mol_type = genomic DNA
agccttacaactcacaagtcccttgtacttgtgtacggagggtattctagaaaagagg

SEQ ID NO: 390 - DNA, 58 bp, Glycine max
  source 1..58: mol_type = genomic DNA
agccttacaactcacaagtcccttgtacttgcgtacggagggtattctagaaaagagg

SEQ ID NO: 391 - DNA, 57 bp, Glycine max
  source 1..57: mol_type = genomic DNA
agccttacaactcacaagtcccttgtacttggtacggagggtattctagaaaagagg

SEQ ID NO: 392 - DNA, 57 bp, Glycine max
  source 1..57: mol_type = genomic DNA
agccttacaactcacaagtcccttgtacttgttacggagggtattctagaaaagagg

SEQ ID NO: 393 - DNA, 56 bp, Glycine max
  source 1..56: mol_type = genomic DNA
agccttacaactcacaagtcccttgtacttgtacggagggtattctagaaaagagg

SEQ ID NO: 394 - DNA, 55 bp, Glycine max
  source 1..55: mol_type = genomic DNA
agccttacaactcacaagtcccttgtactttacggagggtattctagaaaagagg

SEQ ID NO: 395 - DNA, 55 bp, Glycine max
  source 1..55: mol_type = genomic DNA
agccttacaactcacaagtcccttgtactgtacggagggtattctagaaaagagg

SEQ ID NO: 396 - DNA, 54 bp, Glycine max
  source 1..54: mol_type = genomic DNA
agccttacaactcacaagccccttgtacttacggagggtattctagaaaagagg

SEQ ID NO: 397 - DNA, 52 bp, Glycine max
  source 1..52: mol_type = genomic DNA
agccttacaactcacaagtcccttgtatacggagggtattctagaaaagagg

SEQ ID NO: 398 - DNA, 52 bp, Glycine max
  source 1..52: mol_type = genomic DNA
agccttacaactcacaagtcccttgtgtacggagggtattctagaaaagagg

SEQ ID NO: 399 - DNA, 50 bp, Glycine max
  source 1..50: mol_type = genomic DNA
agccttacaactcacaagtcccttgtacggagggtattctagaaaagagg

SEQ ID NO: 400 - DNA, 49 bp, Glycine max
  source 1..49: mol_type = genomic DNA
agccttacaactcacaagtccctttacggagggtattctagaaaagagg

SEQ ID NO: 401 - DNA, 48 bp, Glycine max
  source 1..48: mol_type = genomic DNA
agccttacaactcacaagtcccttacggagggtattctagaaaagagg

SEQ ID NO: 402 - DNA, 47 bp, Glycine max
  source 1..47: mol_type = genomic DNA
agccttacaactcacaagtccctacggagggtattctagaaaagagg

SEQ ID NO: 403 - DNA, 43 bp, Glycine max
  source 1..43: mol_type = genomic DNA
agccttacaactcacaagtcccttgtacttgtaagaaaagagg

SEQ ID NO: 404 - DNA, 49 bp, Glycine max
  source 1..49: mol_type = genomic DNA
agccttacaactcacaagtcctaaattaaaggttattctagaaaagagg

SEQ ID NO: 405 - DNA, 227 bp, Glycine max
  source 1..227: mol_type = genomic DNA
agccttacaactcacaagtcccttgtacttgtagaatccagttcataaaacaagtgacacacaacagatatgaactggactacgtcgaacccacaaatcccacaaagcgcgtgaaatcaaatcgctcaaaccacaaaaaagaacaacgcgtttgttacacgctaataccaaaattatacccaaatcttaagctatttatgcgtacggagggtattctagaaaagagg

SEQ ID NO: 406 - DNA, 97 bp, Glycine max
  source 1..97: mol_type = genomic DNA
agccttacaactcacaagtcccttgtacttgtaatgctcccctctaaactcgtatcgcttcagagttgagagtacggagggtattctagaaaagagg

SEQ ID NO: 407 - DNA, 183 bp, Glycine max
  source 1..183: mol_type = genomic DNA
agccttacaactcacaagtcccttgtatatagatacccacaaaataagtaaacccgatccaaaatcttaaatgatgtggaggaagggaaattgttaattattcccctcttctcctacatggatatacctgaaacatgcaatggatggattagattttgtacggagggtattctagaaaagagg

SEQ ID NO: 408 - DNA, 234 bp, Glycine max
  source 1..234: mol_type = genomic DNA
agccttacaactcacaagtcccttgtacttgtaccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttacgtacggagggtattctagaaaagagg

SEQ ID NO: 409 - DNA, 280 bp, Glycine max
  source 1..280: mol_type = genomic DNA
agccttacaactcacaagtcccttgtacttgtaccgaaaatttcagccataaaaaaagttataatagaatttaaagcaaaagtttcattttttaaacatatatactgacacgctccgataaaaatagaggcaagtccgacaacgtcccctccgaggaggtcgtgaagaagatgaaaaactactggagacagctcttgaacgccaagctcatcacccagcgtaagctcgacaacctgactaaggctgagagaggtgtacggagggtattctagaaaagagg

SEQ ID NO: 410 - DNA, 250 bp, Glycine max
  source 1..250: mol_type = genomic DNA
agccttacaactcacaagtcccttgtacttgtactggatttggtgagggatgcttccgttgtcgaaggttctctgcttcctcaacaggtcctctctgttcaacttcaccaacagctcctcggtaccgtccatcttctcaaggatgaagatcgagtgcttcgactccgtcgagatctctggtgtcgaggacaggttcaacgcctcccttgggacttgccacgatcgtacggagggtattctagaaaagagg

SEQ ID NO: 411 - DNA, 161 bp, Glycine max
  source 1..161: mol_type = genomic DNA
agccttacaactcacaagtcccttatgacctcaaaaaaaagattcacctccaacacaccaaataactcgaaaatctctttcctattctctagaaagtataggaacttccactagtccatgaaaaagcctgaactcgtacggagggtattctagaaaagagg

SEQ ID NO: 412 - DNA, 185 bp, Glycine max
  source 1..185: mol_type = genomic DNA
agccttacaactcacaagtcccttgtacttgtacacctggggcatggagagcaccttcctcacagtagcgaaatccctccctttgtcccacacgatctctccagtctcaccgttggtctcgatcagtgggcgcttcctgatctcaccgttggcgagagtgtacggagggtattctagaaaagagg

SEQ ID NO: 413 - DNA, 212 bp, Glycine max
  source 1..212: mol_type = genomic DNA
agccttacaactcacaagtcccttgtacttgtgctaggttagccgaaagatggttatcggttcaaggacgcaaggtgcccctgctttttcagggtaataaggggtagagaaaatgcctcgagccaaagttcgagtaccaggcgctacagcgctgaagtaatccatgccatactcccaggaaaagccgtacggagggtattctagaaaagagg

SEQ ID NO: 414 - DNA, 231 bp, Glycine max
  source 1..231: mol_type = genomic DNA
agccttacaactcacaagtcccttgtacttgtactcaagttcttattttatttcatattttttcctataaaaggttaatggctctataaaggttgagtgacggatccggtcacctaagtgactagggtcacgtgaccctagtcacttattcccgggcaactttattatacaaagttgatagatctcgaattcattccgattaatcgtggcgagggtattctagaaaagagg

SEQ ID NO: 415 - DNA, 98 bp, Zea mays
  source 1..98: mol_type = genomic DNA
tcctctgtaacgatttacgcacctgctgggaattgtaccgtacgtgccccggtcggaggatatatatacctcacacgtacgcgtacgcgtatatatac

SEQ ID NO: 416 - DNA, 98 bp, Zea mays
  source 1..98: mol_type = genomic DNA
tcctctgtaacgatttacgcacctgctgggaattgtaccgtacgtgccccggacggaggatatatatacctcacacgtacgcgtacgcgtatatatac

SEQ ID NO: 417 - DNA, 98 bp, Zea mays
  source 1..98: mol_type = genomic DNA
tcctctgtaacgatttacgcacctgctgggaattgtaccgtacgtgccccgggcggaggatatatatacctcacacgtacgcgtacgcgtatatatac

SEQ ID NO: 418 - DNA, 98 bp, Zea mays
  source 1..98: mol_type = genomic DNA
tcctctgtaacgatttacgcacctgctgggaattgtaccgtacgtgccccggccggaggatatatatacctcacacgtacgcgtacgcgtatatatac

SEQ ID NO: 419 - DNA, 99 bp, Zea mays
  source 1..99: mol_type = genomic DNA
tcctctgtaacgatttacgcacctgctgggaattgtaccgtacgtgccccggatcggaggatatatatacctcacacgtacgcgtacgcgtatatatac

SEQ ID NO: 420 - DNA, 94 bp, Zea mays
  source 1..94: mol_type = genomic DNA
tcctctgtaacgatttacgcacctgctgggaattgtaccgtacgtgccccggaggatatatatacctcacacgtacgcgtacgcgtatatatac

SEQ ID NO: 421 - DNA, 81 bp, Zea mays
  source 1..81: mol_type = genomic DNA
tcctctgtaacgatttacgcacctgctgggaattgtaccgtacgtgccccggttcacacgtacgcgtacgcgtatatatac

SEQ ID NO: 422 - DNA, 65 bp, Zea mays
  source 1..65: mol_type = genomic DNA
tcctctgtaacgatttacgcacctgctgggaattgtaccgtacgtacgcgtacgcgtatatatac

SEQ ID NO: 423 - DNA, 99 bp, Zea mays
  source 1..99: mol_type = genomic DNA
tcctctgtaacgatttacgcacctgctgggaattgtaccgtacgtgccccggttcggaggatatatatacctcacacgtacgcgtacgcgtatatatac

SEQ ID NO: 424 - DNA, 95 bp, Zea mays
  source 1..95: mol_type = genomic DNA
tcctctgtaacgatttacgcacctgctgggaattgtaccgtacgtgcccccggaggatatatatacctcacacgtacgcgtacgcgtatatatac

SEQ ID NO: 425 - DNA, 98 bp, Zea mays
  source 1..98: mol_type = genomic DNA
gaagctgtaacgatttacgcacctgctgggaattgtaccgtacgtgaccccggcggaggatatatatacctcacacgtacgcgtacgcgtatatatac

SEQ ID NO: 426 - DNA, 98 bp, Zea mays
  source 1..98: mol_type = genomic DNA
gaagctgtaacgatttacgcacctgctgggaattgtaccgtacgtgtccccggcggaggatatatatacctcacacgtacgcgtacgcgtatatatac

SEQ ID NO: 427 - DNA, 96 bp, Zea mays
  source 1..96: mol_type = genomic DNA
gaagctgtaacgatttacgcacctgctgggaattgtaccgtacgtccccggcggaggatatatatacctcacacgtacgcgtacgcgtatatatac

SEQ ID NO: 428 - DNA, 98 bp, Zea mays
  source 1..98: mol_type = genomic DNA
gaagctgtaacgatttacgcacctgctgggaattgtaccgtacgtggccccggcggaggatatatatacctcacacgtacgcgtacgcgtatatatac

SEQ ID NO: 429 - DNA, 99 bp, Zea mays
  source 1..99: mol_type = genomic DNA
gaagctgtaacgatttacgcacctgctgggaattgtaccgtacgtgcaccccggcggaggatatatatacctcacacgtacgcgtacgcgtatatatac

SEQ ID NO: 430 - DNA, 87 bp, Zea mays
  source 1..87: mol_type = genomic DNA
gaagctgtaacgatttacgcacctgctgggaattgtacccggcggaggatatatatacctcacacgtacgcgtacgcgtatatatac

SEQ ID NO: 431 - DNA, 92 bp, Zea mays
  source 1..92: mol_type = genomic DNA
gaagctgtaacgatttacgcacctgctgggaattgtaccgtccccggcggaggatatatatacctcacacgtacgcgtacgcgtatatatac

SEQ ID NO: 432 - DNA, 94 bp, Zea mays
  source 1..94: mol_type = genomic DNA
gaagctgtaacgatttacgcacctgctgggaattgtaccgtacccccggcggaggatatatatacctcacacgtacgcgtacgcgtatatatac

SEQ ID NO: 433 - DNA, 95 bp, Zea mays
  source 1..95: mol_type = genomic DNA
gaagctgtaacgatttacgcacctgctgggaattgtaccgtacgccccggcggaggatatatatacctcacacgtacgcgtacgcgtatatatac

SEQ ID NO: 434 - DNA, 88 bp, Zea mays
  source 1..88: mol_type = genomic DNA
gaagctgtaacgatttacgcacctgctgggaattgtaccccggcggaggatatatatacctcacacgtacgcgtacgcgtatatatac

SEQ ID NO: 435 - DNA, 98 bp, Zea mays; identical to SEQ ID NO: 77
  source 1..98: mol_type = genomic DNA

SEQ ID NO: 436 - DNA, 96 bp, Zea mays; identical to SEQ ID NO: 78
  source 1..96: mol_type = genomic DNA

SEQ ID NO: 437 - DNA, 95 bp, Zea mays; identical to SEQ ID NO: 80
  source 1..95: mol_type = genomic DNA

SEQ ID NO: 438 - DNA, 96 bp, Zea mays; identical to SEQ ID NO: 79
  source 1..96: mol_type = genomic DNA

SEQ ID NO: 439 - DNA, 68 bp, Zea mays; identical to SEQ ID NO: 81
  source 1..68: mol_type = genomic DNA

SEQ ID NO: 440 - DNA, 93 bp, Zea mays; identical to SEQ ID NO: 83
  source 1..93: mol_type = genomic DNA

SEQ ID NO: 441 - DNA, 89 bp, Zea mays
  source 1..89: mol_type = genomic DNA
aaggcgcaaatgagtagcagcgcacgtatatatacgcgtacgtgaggtatatatatcctccgccggggcacgtacggtacaattcccag

SEQ ID NO: 442 - DNA, 89 bp, Zea mays
  source 1..89: mol_type = genomic DNA
aaggcgcaaatgagtagcagcgcacgtatatatacgcgtacgcgtactatatatatcctccgccggggcacgtacggtacaattcccag

SEQ ID NO: 443 - DNA, 94 bp, Zea mays
  source 1..94: mol_type = genomic DNA
aaggcgcaaatgagtagcagcgcacgtatatatacgcgtacgcgtacggaggtatatatatcctccgccggggcacgtacggtacaattcccag

SEQ ID NO: 444 - DNA, 96 bp, Zea mays
  source 1..96: mol_type = genomic DNA
aaggcgcaaatgagtagcagcgcacgtatatatacgcgtacgcgtacgatgaggtatatatatcctccgccggggcacgtacggtacaattcccag

SEQ ID NO: 445 - DNA, 1051 bp, synthetic construct
  misc_feature 1..1051: note = synthesized sequence- LIGCas-1_crRNA_Expression_Cassette
  source 1..1051: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtaccgtacgtgccccggcgggttttagagctatgctgttttgtttttttt

SEQ ID NO: 446 - DNA, 1051 bp, synthetic construct
  misc_feature 1..1051: note = synthesized sequence- LIGCas-2_crRNA_Expression_Cassette
  source 1..1051: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattggaattgtaccgtacgtgcccgttttagagctatgctgttttgtttttttt

SEQ ID NO: 447 - DNA, 1047 bp, synthetic construct
  misc_feature 1..1047: note = synthesized sequence- LIGCas-3_crRNA_Expression_Cassette
  source 1..1047: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcgtacgcgtacgtgtggttttagagctatgctgttttgtttttttt

SEQ ID NO: 448 - DNA, 1087 bp, synthetic construct
  misc_feature 1..1087: note = synthesized sequence- tracrRNA_Expression_Cassette
  source 1..1087: mol_type = other DNA
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattggaaccattcaaaacagcatagcaagttaaaataaggctagtccgttatcaacttgaaaaagtggcaccgagtcggtgctttttttt

SEQ ID NO: 449 - DNA, 63 bp, synthetic construct
  misc_feature 1..63: note = synthesized sequence- LIGCas-2 forward primer for primary
  source 1..63: mol_type = other DNA
ctacactctttccctacacgacgctcttccgatctgaagctgtaacgatttacgcacctgctg

SEQ ID NO: 450 - DNA, 60 bp, synthetic construct
  misc_feature 1..60: note = synthesized sequence- LIGCas-3 forward primer for primary PCR
  source 1..60: mol_type = other DNA
ctacactctttccctacacgacgctcttccgatctttcccgcaaatgagtagcagcgcac

SEQ ID NO: 451 - DNA, 19 bp, Zea mays
  source 1..19: mol_type = genomic DNA
gcgtgcatcgatccatcgc

SEQ ID NO: 452 - DNA, 21 bp, Zea mays
  source 1..21: mol_type = genomic DNA
ggctacggatagatatgatgc

SEQ ID NO: 453 - DNA, 20 bp, Zea mays
  source 1..20: mol_type = genomic DNA
gttacttctctaagcacggc

SEQ ID NO: 454 - DNA, 21 bp, synthetic construct
  misc_feature 1..21: note = synthesized sequence- P1, Forward_primer
  source 1..21: mol_type = other DNA
gcgccattccctaaaggtaac

SEQ ID NO: 455 - DNA, 23 bp, synthetic construct
  misc_feature 1..23: note = synthesized sequence- P2, Reverse_primer
  source 1..23: mol_type = other DNA
gctaatcgtaagtgacgcttgga

SEQ ID NO: 456 - DNA, 31 bp, synthetic construct; identical to SEQ ID NO: 99
  misc_feature 1..31: note = synthesized sequence- P3, Forward_primer
  source 1..31: mol_type = other DNA

SEQ ID NO: 457 - DNA, 20 bp, synthetic construct
  misc_feature 1..20: note = synthesized sequence- P4, Reverse_primer
  source 1..20: mol_type = other DNA
ctgcgaactgcttgattccg

SEQ ID NO: 458 - DNA, 24 bp, synthetic construct
  misc_feature 1..24: note = synthesized sequence- P5, Forward_primer
  source 1..24: mol_type = other DNA
accgtccttatctctgcatcatct

SEQ ID NO: 459 - DNA, 31 bp, synthetic construct; identical to SEQ ID NO: 99
  misc_feature 1..31: note = synthesized sequence- PBS, Primer Binding Site
  source 1..31: mol_type = other DNA

SEQ ID NO: 460 - DNA, 1823 bp, Zea mays
  misc_feature 1..1823: note = Zm-GOS2 PRO-GOS2 INTRON, maize GOS2 promoter and GOS2 intron1 including the promoter, 5'-UTR1, INTRON1 and 5'-UTR2 sequence
  source 1..1823: mol_type = genomic DNA
taattattggctgtaggattctaaacagagcctaaatagctggaatagctctagccctcaatccaaactaatgatatctatacttatgcaactctaaatttttattctaaaagtaatatttcatttttgtcaacgagattctctactctattccacaatcttttgaagctatatttaccttaaatctgtactctataccaataatcatatattctattatttatttttatctctctcctaaggagcatccctctatgtctgcatggcccccgcctcgggtcccaatctcttgctctgctagtagcacagaagaaaacactagaaatgacttgcttgacttagagtatcagataaacatcatgtttacttaactttaatttgtatcggtttctactatttttataatatttttgtctctatagatactacgtgcaacagtataatcaacctagtttaatccagagcgaaggattttttactaagtacgtgactccatatgcacagcgttccttttatggttcctcactgggcacagcataaacgaaccctgtccaatgttttcagcgcgaacaaacagaaattccatcagcgaacaaacaacatacatgcgagatgaaaataaataataaaaaaagctccgtctcgataggccggcacgaatcgagagcctccatagccagttttttccatcggaacggcggttcgcgcacctaattatatgcaccacacgcctataaagccaaccaacccgtcggaggggcgcaagccagacagaagacagcccgtcagcccctctcgtttttcatccgccttcgcctccaaccgcgtgcgctccacgcctcctccaggaaagcgagaggtgagcgcagtcccctttcccctccttccaattcaattcgtcttctcgttcgcagccctaggatttgggggtctggaggggtttgatcgtttctcgccgtgaatctgctttggtgtaaaccaacggatctcggatcgtagtcttcagaagatcccggattttgcggtttggcccctcctggattcaattcgtcgtatcgttcgcagccctaggatttggggatctggaggggtttgatcgtttctcgccgcgaatctgctctggtgtaaaccaacggatctcgggtcgtagtcttcagaaggtcccggattttgcggtttggcccctcctggattcaattcgtcgtatcgttcgcagccctaggatttggggatctggaggggtttgatcctttctcgccgcgaatctgctctggtataaccaacggatctcgggtcgtagtcttcagaaggtcccggattttgcggtttggtggttcttgctctatgaatcagagggatggttcttcccggatttatgccttgcggccactctgtcgaatcatggggtttcgacccgattcgtaggcgtgctccctgttttggatgggaagtaggcgtgtttgtagtattcgtgcttcgattcgtcaacggagattagaagacctgggatgggatttgaggaaatctaggtatctgtctagcacgtttctagatctattcttcagctgttatatgagagtaattttggaaccctggtggggtatgtttgaccgagtattctgtagattattgtccgtgacttgctggctgttaccgtccttatctctgcatcatctatctgtgctagtttctgcgtgcttctcaaatatttccggcctgtgtagcatgtgactgataatatgattttggcagcttctgcataagaacaacaaatcaaaagcttgatcagctcggtgcctacaaaacctcaacaaccaagtttc

SEQ ID NO: 461 - DNA, 556 bp, Zea mays
  misc_feature 1..556: note = Zm-ARGOS8 promoter
  source 1..556: mol_type = genomic DNA
gttacttctctaagcacggctggatttcaggcctctagtcctctactagtactagctacacgacgtgcacgcatgcatcacagcatcaacaactagacacgcacacgctgcacgcggccggggaacccactgattccccccttccccgcgcgcggtttgatttcctttcctggtacggatccatatctgagggcttgttcggttattcccaacacacatgtattggatgggattgaaaaaaaaatgagaagaagtttgacttgtttgggattcaaacccatccaatcccactcaatccacatggattgagagctaaccgaacaagccctcatagtacatacctggtacggatccatatcatagtacatagatccagtagaatagaaggtgatccgaccgccggcgcttgcgttgttttccccggtccattgaacctgccaaccctcctaaccacaggcacgccaaaccgcgggctccggccaccaccgccaccgccacctgccctgccgcacctctccaaccccaaatccaggggggggggggggcaccatgcgtg

SEQ ID NO: 462 - DNA, 155 bp, Zea mays
  misc_feature 1..155: note = Zm-ARGOS8 5'-UTR
  source 1..155: mol_type = genomic DNA
catcgatccatcgctggcgcgcgggtccggcggggcggtctgtgagggcaaatttatataggtctagtgggtacccggctacggatagatatgatgctgcactgcacattggctatatctgaggctcctgcgcgcgccttggccaggtgtctgtc

SEQ ID NO: 463 - DNA, 285 bp, Zea mays
  source 1..285: mol_type = genomic DNA
atgcgggcgatgccgcaggaagaggaagccgcggtggcgacgacgaccatggccgggggcaaggtggcggcgctgctggccacggcggccgcgctgctgctgctgctcccgctggcgctgccgccgctgccgccgccgcccacgcagctgttgttcgtccccgtggtcttgctgctcctcgtggcgtccctcgcgttctgccccgccgcgaccccctcgccgtcgccgatgcatgccgccgaccacgggtcgttcgggaccactggatcaccgcacctatgttga

SEQ ID NO: 464 - DNA, 2843 bp, Zea mays
  misc_feature 1..2843: note = Zm-GOS2 gene, including promoter, 5'-UTR, CDS, 3'-UTR and introns sequence
  source 1..2843: mol_type = genomic DNA
taattattggctgtaggattctaaacagagcctaaatagctggaatagctctagccctcaatccaaactaatgatatctatacttatgcaactctaaatttttattctaaaagtaatatttcatttttgtcaacgagattctctactctattccacaatcttttgaagctatatttaccttaaatctgtactctataccaataatcatatattctattatttatttttatctctctcctaaggagcatccctctatgtctgcatggcccccgcctcgggtcccaatctcttgctctgctagtagcacagaagaaaacactagaaatgacttgcttgacttagagtatcagataaacatcatgtttacttaactttaatttgtatcggtttctactatttttataatatttttgtctctatagatactacgtgcaacagtataatcaacctagtttaatccagagcgaaggattttttactaagtacgtgactccatatgcacagcgttccttttatggttcctcactgggcacagcataaacgaaccctgtccaatgttttcagcgcgaacaaacagaaattccatcagcgaacaaacaacatacatgcgagatgaaaataaataataaaaaaagctccgtctcgataggccggcacgaatcgagagcctccatagccagttttttccatcggaacggcggttcgcgcacctaattatatgcaccacacgcctataaagccaaccaacccgtcggaggggcgcaagccagacagaagacagcccgtcagcccctctcgtttttcatccgccttcgcctccaaccgcgtgcgctccacgcctcctccaggaaagcgagaggtgagcgcagtcccctttcccctccttccaattcaattcgtcttctcgttcgcagccctaggatttgggggtctggaggggtttgatcgtttctcgccgtgaatctgctttggtgtaaaccaacggatctcggatcgtagtcttcagaagatcccggattttgcggtttggcccctcctggattcaattcgtcgtatcgttcgcagccctaggatttggggatctggaggggtttgatcgtttctcgccgcgaatctgctctggtgtaaaccaacggatctcgggtcgtagtcttcagaaggtcccggattttgcggtttggcccctcctggattcaattcgtcgtatcgttcgcagccctaggatttggggatctggaggggtttgatcctttctcgccgcgaatctgctctggtataaccaacggatctcgggtcgtagtcttcagaaggtcccggattttgcggtttggtggttcttgctctatgaatcagagggatggttcttcccggatttatgccttgcggccactctgtcgaatcatggggtttcgacccgattcgtaggcgtgctccctgttttggatgggaagtaggcgtgtttgtagtattcgtgcttcgattcgtcaacggagattagaagacctgggatgggatttgaggaaatctaggtatctgtctagcacgtttctagatctattcttcagctgttatatgagagtaattttggaaccctggtggggtatgtttgaccgagtattctgtagattattgtccgtgacttgctggctgttaccgtccttatctctgcatcatctatctgtgctagtttctgcgtgcttctcaaatatttccggcctgtgtagcatgtgactgataatatgattttggcagcttctgcataagaacaacaaatcaaaagcttgatcagctcggtgcctacaaaacctcaacaaccaagtttcatgtctgatctcgacgtccagcttccatctgcctttggtatggctacttctcaattcatgatgccatgtttttttttatattgtggttttacataatacatagcatcttccagcttcctgaagagtattactgaatagattgataacatcatacacacgaagttcatcttgaacatgcttattagtgttctgtttgcatctgatggtatggcatcatctttgatagatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtaagatacgagaacaatgcatttcaagcttgtaaaaatggtatctgccggttggtggatatactgatctgtttgtccgctgcaggtcattcagctccaaggtgaccagcgcaagaatgttgctactttcctagttcaggtattcagaatcttcagacctggccagctgaatactgttttaccataccgatagatgttcaatctgttaatactgatcgtgcaattattacttgtcttggtaggctgggattgcgaagaaagagaacatcaagattcacgggttctaagggacctgtaaatgcttgtgccctatattgtgtgcctccacatattggggagcttgaagcatcgacagttactagtcattgcttacttatataagaacataagtagtatttgctattgtcaagtgtgccttgcttgatgcaagttgtgttttcgtatcattattattatgcacggccatcgtacgtgtatggcttgtatgggttattgccaacttaataaaagcacactctgtttgcctataagcactgatgtttgcctcgtcatgcacatgttgagtcgggttttatttgtatt

SEQ ID NO: 465 - DNA, 800 bp, Zea mays
  misc_feature 1..800: note = Zm-GOS2 PRO, maize GOS2 promoter
  source 1..800: mol_type = genomic DNA
taattattggctgtaggattctaaacagagcctaaatagctggaatagctctagccctcaatccaaactaatgatatctatacttatgcaactctaaatttttattctaaaagtaatatttcatttttgtcaacgagattctctactctattccacaatcttttgaagctatatttaccttaaatctgtactctataccaataatcatatattctattatttatttttatctctctcctaaggagcatccctctatgtctgcatggcccccgcctcgggtcccaatctcttgctctgctagtagcacagaagaaaacactagaaatgacttgcttgacttagagtatcagataaacatcatgtttacttaactttaatttgtatcggtttctactatttttataatatttttgtctctatagatactacgtgcaacagtataatcaacctagtttaatccagagcgaaggattttttactaagtacgtgactccatatgcacagcgttccttttatggttcctcactgggcacagcataaacgaaccctgtccaatgttttcagcgcgaacaaacagaaattccatcagcgaacaaacaacatacatgcgagatgaaaataaataataaaaaaagctccgtctcgataggccggcacgaatcgagagcctccatagccagttttttccatcggaacggcggttcgcgcacctaattatatgcaccacacgcctataaagccaaccaacccgtcggaggggcgcaagccagacagaagacagcccgtcagcccctctcgtt

SEQ ID NO: 466 - DNA, 1023 bp, Zea mays
  misc_feature 1..1023: note = GOS2 INTRON, maize GOS2 5'-UTR1 and intron1 and 5'-UTR2 sequence
  source 1..1023: mol_type = genomic DNA
tttcatccgccttcgcctccaaccgcgtgcgctccacgcctcctccaggaaagcgagaggtgagcgcagtcccctttcccctccttccaattcaattcgtcttctcgttcgcagccctaggatttgggggtctggaggggtttgatcgtttctcgccgtgaatctgctttggtgtaaaccaacggatctcggatcgtagtcttcagaagatcccggattttgcggtttggcccctcctggattcaattcgtcgtatcgttcgcagccctaggatttggggatctggaggggtttgatcgtttctcgccgcgaatctgctctggtgtaaaccaacggatctcgggtcgtagtcttcagaaggtcccggattttgcggtttggcccctcctggattcaattcgtcgtatcgttcgcagccctaggatttggggatctggaggggtttgatcctttctcgccgcgaatctgctctggtataaccaacggatctcgggtcgtagtcttcagaaggtcccggattttgcggtttggtggttcttgctctatgaatcagagggatggttcttcccggatttatgccttgcggccactctgtcgaatcatggggtttcgacccgattcgtaggcgtgctccctgttttggatgggaagtaggcgtgtttgtagtattcgtgcttcgattcgtcaacggagattagaagacctgggatgggatttgaggaaatctaggtatctgtctagcacgtttctagatctattcttcagctgttatatgagagtaattttggaaccctggtggggtatgtttgaccgagtattctgtagattattgtccgtgacttgctggctgttaccgtccttatctctgcatcatctatctgtgctagtttctgcgtgcttctcaaatatttccggcctgtgtagcatgtgactgataatatgattttggcagcttctgcataagaacaacaaatcaaaagcttgatcagctcggtgcctacaaaacctcaacaaccaagtttc

SEQ ID NO: 467 - DNA, 23 bp, Glycine max
  source 1..23: mol_type = genomic DNA
gcgtcctttgacagcagctgtgg

SEQ ID NO: 468 - DNA, 23 bp, Glycine max
  source 1..23: mol_type = genomic DNA
gcaaccacagctgctgtcaaagg

SEQ ID NO: 469 - DNA, 434 bp, Glycine max; identical to SEQ ID NO: 120
  source 1..434: mol_type = genomic DNA

SEQ ID NO: 470 - DNA, 9093 bp, synthetic construct
  misc_feature 1..9093: note = synthesized sequence- QC878
  source 1..9093: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgcgtcctttgacagcagctggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccggtac

SEQ ID NO: 471 - DNA, 9093 bp, synthetic construct
  misc_feature 1..9093: note = synthesized sequence- QC879
  source 1..9093: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgcaaccacagctgctgtcaagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccggtac

SEQ ID NO: 472 - DNA, 1357 bp, synthetic construct
  misc_feature 1..1357: note = synthesized sequence- RTW1013A
  source 1..1357: mol_type = other DNA
ctagaagataaaccctcccccaaaacacaaattagaatgacatttcaagttccatgtatgtcactttcattctattatttttacaacttttagttacttaacagatgtcttgttcagcataaattataatttattctgtttttttttagggaacaactgttgtagacaacttgttgtatagtgaggatattcattacatgcttggtgcattaaggacccttggactgcgtgtggaagatgacaaaacaaccaaacaagcaattgttgaaggctgtgggggattgtttcccactagtaaggaatctaaagatgaaatcaatttattccttggaaatgctggtattgcaatgagatctttgacagcagctgttgttgctgcaggtggaaatgcaaggtctgttttttttttttttgttcagcataatctttgaattgttcctcgtataactaatcacaacagagtacgtgttcttcttcctgttataatctaaaaatctcatccagattagtcatcctttcttcttaaaaggaacctttaattatcaatgtatttatttaatatttaaattagcttgtcaaagtctagcatatacatattttgattatattctgagaaatgcacctgagggtgttcctcatgatctacttcaacctctgttattattagattttctatcatgattactggtttgagtctctaagtagaccatcttgatgttcaaaatatttcagctacgtacttgatggggtgccccgaatgagagagaggccaattggggatttggttgctggtcttaagcaacttggtgcagatgttgattgctttcttggcacaaactgtccacctgttcgtgtaaatgggaagggaggacttcctggcggaaaggtatggtttggatttcatttagaataaggtggagtaactttcctggatcaaaattctaatttaagaagcctccctgttttcctctctttagaataagactaagggtaggtttaggagttgggttttggagagaaatggaagggagagcaatttttttcttcttctaataaatattctttaatttgatacattttttaagtaaaagaatataaagatagattagcataacttaatgttttaatcttttatttatttttataaatattatatacctgtctatttaaaaatcaaatatttgtcctccattccctttcccttcaaaacctcagttccaaatataccgtagttgaattatattttggaaggcctattggttggagacttttccttttcagagattatccctcacctttattatagcctttctatttttaaacttcatatagacgccattcttggggcggccgcgat

SEQ ID NO: 473 - DNA, 1357 bp, synthetic construct
  misc_feature 1..1357: note = synthesized sequence- RTW1012A
  source 1..1357: mol_type = other DNA
ctagaagataaaccctcccccaaaacacaaattagaatgacatttcaagttccatgtatgtcactttcattctattatttttacaacttttagttacttaacagatgtcttgttcagcataaattataatttattctgtttttttttagggaacaactgttgtagacaacttgttgtatagtgaggatattcattacatgcttggtgcattaaggacccttggactgcgtgtggaagatgacaaaacaaccaaacaagcaattgttgaaggctgtgggggattgtttcccactagtaaggaatctaaagatgaaatcaatttattccttggaaatgctggtattgcaatgagatctttgacagcagctgtggttgctgcaggtggaaatgcaaggtctgttttttttttttttgttcagcataatctttgaattgttcctcgtataactaatcacaacagagtacgtgttcttcttcctgttataatctaaaaatctcatccagattagtcatcctttcttcttaaaaggaacctttaattatcaatgtatttatttaatatttaaattagcttgtcaaagtctagcatatacatattttgattatattctgagaaatgcacctgagggtgttcctcatgatctacttcaacctctgttattattagattttctatcatgattactggtttgagtctctaagtagaccatcttgatgttcaaaatatttcagctacgtacttgatggggtgccccgaatgagagagaggccaattggggatttggttgctggtcttaagcaacttggtgcagatgttgattgctttcttggcacaaactgtccacctgttcgtgtaaatgggaagggaggacttcctggcggaaaggtatggtttggatttcatttagaataaggtggagtaactttcctggatcaaaattctaatttaagaagcctccctgttttcctctctttagaataagactaagggtaggtttaggagttgggttttggagagaaatggaagggagagcaatttttttcttcttctaataaatattctttaatttgatacattttttaagtaaaagaatataaagatagattagcataacttaatgttttaatcttttatttatttttataaatattatatacctgtctatttaaaaatcaaatatttgtcctccattccctttcccttcaaaacctcagttccaaatataccgtagttgaattatattttggaaggcctattggttggagacttttccttttcagagattatccctcacctttattatagcctttctatttttaaacttcatatagacgccattcttggggcggccgcgat

SEQ ID NO: 474 - DNA, 30 bp, synthetic construct
  misc_feature 1..30: note = synthesized sequence- primer, soy1-F1
  source 1..30: mol_type = other DNA
ccactagtaaggaatctaaagatgaaatca

SEQ ID NO: 475 - DNA, 24 bp, synthetic construct
  misc_feature 1..24: note = synthesized sequence- primer, soy1-R2
  source 1..24: mol_type = other DNA
cctgcagcaaccacagctgctgtc

SEQ ID NO: 476 - DNA, 15 bp, synthetic construct
  misc_feature 1..15: note = synthesized sequence- probe, soy1-T1(FAM-MGB
  source 1..15: mol_type = other DNA
ctgcaatgcgtcctt

SEQ ID NO: 477 - DNA, 19 bp, synthetic construct
  misc_feature 1..19: note = synthesized sequence- primer, cas9-F
  source 1..19: mol_type = other DNA
ccttcttccaccgccttga

SEQ ID NO: 478 - DNA, 21 bp, synthetic construct
  misc_feature 1..21: note = synthesized sequence- primer, Cas9-R
  source 1..21: mol_type = other DNA
tgggtgtctctcgtgcttttt

SEQ ID NO: 479 - DNA, 19 bp, synthetic construct
  misc_feature 1..19: note = synthesized sequence- probe, Cas9-T(FAM-MGB)
  source 1..19: mol_type = other DNA
aatcattcctggtggagga

SEQ ID NO: 480 - DNA, 25 bp, synthetic construct
  misc_feature 1..25: note = synthesized sequence- primer, pINII-99F
  source 1..25: mol_type = other DNA
tgatgcccacattatagtgattagc

SEQ ID NO: 481 - DNA, 22 bp, synthetic construct
  misc_feature 1..22: note = synthesized sequence- primer, pINII-13R
  source 1..22: mol_type = other DNA
catcttctggattggccaactt

SEQ ID NO: 482 - DNA, 17 bp, synthetic construct
  misc_feature 1..17: note = synthesized sequence- probe, pINII-69T(FAM-MGB)
  source 1..17: mol_type = other DNA
actatgtgtgcatcctt

SEQ ID NO: 483 - DNA, 23 bp, synthetic construct
  misc_feature 1..23: note = synthesized sequence- primer, SIP-130F
  source 1..23: mol_type = other DNA
ttcaagttgggctttttcagaag

SEQ ID NO: 484 - DNA, 22 bp, synthetic construct
  misc_feature 1..22: note = synthesized sequence- primer, SIP-198R
  source 1..22: mol_type = other DNA
tctccttggtgctctcatcaca

SEQ ID NO: 485 - DNA, 15 bp, synthetic construct
  misc_feature 1..15: note = synthesized sequence- probe, SIP-170T(VIC-MGB)
  source 1..15: mol_type = other DNA
ctgcagcagaaccaa

SEQ ID NO: 486 - DNA, 24 bp, synthetic construct
  misc_feature 1..24: note = synthesized sequence- WOL569, Forward_primer
  source 1..24: mol_type = other DNA
ggacccattaggtgagagcgtggg

SEQ ID NO: 487 - DNA, 19 bp, synthetic construct
  misc_feature 1..19: note = synthesized sequence- WOL876, Reverse_primer
  source 1..19: mol_type = other DNA
cagctgctgtcaaagatct

SEQ ID NO: 488 - DNA, 29 bp, synthetic construct
  misc_feature 1..29: note = synthesized sequence- WOL570, Reverse_primer
  source 1..29: mol_type = other DNA
tctaataataacagaggttgaagtagatc

SEQ ID NO: 489 - DNA, 4104 bp, Glycine max; identical to SEQ ID NO: 115
  source 1..4104: mol_type = genomic DNA

SEQ ID NO: 490 - DNA, 23 bp, Glycine max
  source 1..23: mol_type = genomic DNA
gtttgtttgttgttgggtgtggg

SEQ ID NO: 491 - DNA, 22 bp, Glycine max
  source 1..22: mol_type = genomic DNA
tgttgttgggtgtgggaatagg

SEQ ID NO: 492 - DNA, 9174 bp, synthetic construct
  misc_feature 1..9174: note = synthesized sequence- RTW1199
  source 1..9174: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtttgtttgttgttgggtgtgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgctcgggcgcgccggtac

SEQ ID NO: 493 - DNA, 9174 bp, synthetic construct
  misc_feature 1..9174: note = synthesized sequence- RTW1200
  source 1..9174: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtgttgttgggtgtgggaatgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgctcgggcgcgccggtac

SEQ ID NO: 494 - DNA, 3175 bp, synthetic construct
  misc_feature 1..3175: note = synthesized sequence- RTW1190A
  source 1..3175: mol_type = other DNA
cgaattctacaggtcactaataccatctaagtagttggttcatagtgactgcatatgtaaaaattatccttattttaaggaaattaaaaattatcatatatatataagttttaaattaattatcttatatatgtaccaaaaagttttaaagcaattattataaaaattaataaatttatcatataaaataatttataattaaattttaaattatcaattcattaaattaaattatttaaaatttttgaatgataatataataattttatcctctactaagtcccaacgtttcctattttattccacttttagcaataaattttgtcataaacacttataacaaaaaaagtaagtaaaaaataaaaaaaagtttttcaataaagtataaactaatttgtataaacttttagaaaaaataaagttatacattgataatataaattttttacataattatccgatcaactcattatatatgataaatttattgattttttaaaataattatcttaaaataatttaaacaatgatttgcaattagatgataatataaaattattttacacactacatgtattaaactcaaacttttatatattagtttttctaaaaactaatttttaactcaaaaaaaatgttacttataattttcttatcttctttttttataagtattttttaagaaatttattgaaacatgaccatgcttgggtcaataatactactctcttagacaccaaacaacccttcccaaactataatctaatccaaaagccatcattcattttccttggtaggtaaagttccaagaccttcaccaactttttcactcaattgttttggtgtaagcaattcgacatgtgttagtgttagttggcaaccaaaaatccctttatgtgactcaatccaacaaccactcacaccaccaacccccataaccatttctcacaatacccttcatttacacattatcatcaccaaaaataaataaaaaaaacctctcatttcagagagagagagagagacttcacagaccaaagtgcagagaacaacaaagttcacaactttaaggaaaattgaaatggcccaagtgagcagagtgcacaatcttgctcaaagcactcaaatttttggccattcttccaactccaacaaactcaaatcggtgaattcggtttcattgaggccacgcctttggggggcctcaaaatctcgcatcccgatgcataaaaatggaagctttatgggaaattttaatgtggggaagggaaattccggcgtgtttaaggtttctgcatcggtcgccgccgcagagaagccgtcaacgtcgccggagatcgtgttggaacccatcaaagacttctcgggtaccatcacattgccagggtccaagtctctgtccaatcgaattttgcttcttgctgctctctctgaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagggaacaactgttgtagacaacttgttgtatagtgaggatattcattacatgcttggtgcattaaggacccttggactgcgtgtggaagatgacaaaacaaccaaacaagcaattgttgaaggctgtgggggattgtttcccactagtaaggaatctaaagatgaaatcaatttattccttggaaatgctggtattgcaatgagatctttgacagcagctgttgttgctgcaggtggaaatgcaaggtctgttttttttttttttgttcagcataatctttgaattgttcctcgtataactaatcacaacagagtacgtgttcttcttcctgttataatctaaaaatctcatccagattagtcatcctttcttcttaaaaggaacctttaattatcaatgtatttatttaatatttaaattagcttgtcaaagtctagcatatacatattttgattatattctgagaaatgcacctgagggtgttcctcatgatctacttcaacctctgttattattagattttctatcatgattactggtttgagtctctaagtagaccatcttgatgttcaaaatatttcagctacgtacttgatggggtgccccgaatgagagagaggccaattggggatttggttgctggtcttaagcaacttggtgcagatgttgattgctttcttggcacaaactgtccacctgttcgtgtaaatgggaagggaggacttcctggcggaaaggtatggtttggatttcatttagaataaggtggagtaactttcctggatcaaaattctaatttaagaagcctccctgttttcctctctttagaataagactaagggtaggtttaggagttgggttttggagagaaatggaagggagagcaatttttttcttcttctaataaatattctttaatttgatacattttttaagtaaaagaatataaagatagattagcataacttaatgttttaatcttttatttatttttataaatattatatacctgtctatttaaaaatcaaatatttgtcctccattccctttcccttcaaaacctcagttccaaatataccgtagttgaattatattttggaaggcctattggttggagacttttccttttcagagattatccctcacctttattatagcctttctatttttaaacttcatatagacgccattcttggggcggccgcgat

SEQ ID NO: 495 - DNA, 23 bp, synthetic construct
  misc_feature 1..23: note = synthesized sequence- primer, soy1-F3
  source 1..23: mol_type = other DNA
gtttgtttgttgttgggtgtggg

SEQ ID NO: 496 - DNA, 25 bp, synthetic construct
  misc_feature 1..25: note = synthesized sequence- primer, soy1-R3
  source 1..25: mol_type = other DNA
gacatgatgcttcattttcacagaa

SEQ ID NO: 497 - DNA, 18 bp, synthetic construct
  misc_feature 1..18: note = synthesized sequence- probe, soy1-T2(FAM-MGB)
  source 1..18: mol_type = other DNA
tgtgtagagtggattttg

SEQ ID NO: 498 - DNA, 22 bp, synthetic construct
  misc_feature 1..22: note = synthesized sequence- primer, soy1-F2
  source 1..22: mol_type = other DNA
tgttgttgggtgtgggaatagg

SEQ ID NO: 499 - DNA, 31 bp, synthetic construct
  misc_feature 1..31: note = synthesized sequence- WOL1001, Forward_primer
  source 1..31: mol_type = other DNA
aggtttaattttatataatgttagcatacag

SEQ ID NO: 500 - DNA, 28 bp, synthetic construct
  misc_feature 1..28: note = synthesized sequence- 500 WOL1002, Reverse_primer
  source 1..28: mol_type = other DNA
atcaacatcatgctgatgtagaacaaac

SEQ ID NO: 501 - DNA, 29 bp, synthetic construct
  misc_feature 1..29: note = synthesized sequence- 501 WOL1003, Forward_primer
  source 1..29: mol_type = other DNA
attctgatttatcttgtgattgttgactc

SEQ ID NO: 502 - DNA, 27 bp, synthetic construct
  misc_feature 1..27: note = synthesized sequence- WOL1004, Reverse_primer
  source 1..27: mol_type = other DNA
atttactttggagagaataaggagggg

SEQ ID NO: 503 - DNA, 23 bp, Glycine max
  source 1..23: mol_type = genomic DNA
gaaacgttgggacttagtagagg

SEQ ID NO: 504 - DNA, 23 bp, Glycine max
  source 1..23: mol_type = genomic DNA
ggaataaaataggaaacgttggg

SEQ ID NO: 505 - DNA, 9174 bp, synthetic construct
  misc_feature 1..9174: note = synthesized sequence- RTW1201
  source 1..9174: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgaaacgttgggacttagtaggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgctcgggcgcgccggtac

SEQ ID NO: 506 - DNA, 9174 bp, synthetic construct
  misc_feature 1..9174: note = synthesized sequence- RTW1202
  source 1..9174: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggaataaaataggaaacgttgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgctcgggcgcgccggtac

SEQ ID NO: 507 - DNA, 6113 bp, synthetic construct
  misc_feature 1..6113: note = synthesized sequence- RTW1192A
  source 1..6113: mol_type = other DNA
caagtagttctagtcttaatacaaatgtcaaatggcacaagtgagattttgaatttctgatgttgtaaaaatctcaggacatgaatactattgggaagcaattattcatacttcaccaatccaaactgacccaaaattctcaaatcacatgaaagcaaaaatgcatataacacgaagaataagaagaagaggaactaacctggggtttcgatgattaaagcgttgttgttgatgatgaaaacgatgattatggagagaaattgttgttgaatggtgaaattgttatagaaagagaacgaagatagagaaaaagatatatagatttttcaaggctcaaaccctaaaatcaccatgagagagaacaaagattgagaaacctacaaccactatgagagagaatgagcagaacagaagcgtgagatagagaacgagagttaaggtgcgagaggacacgaagaacaaaaggtgtgagagaaagaacaaaggagcctacggtgtgagatgagagaatttgaaattcttaccatttaggtggaatttcaattctacaattttattctattaaaattattttaaaaaatgatgtcattttaaattctttaaaatctcatatccaacaactgaattatgatagaggtatttcaaattcacttaaaaaaattatcttatttaaataccccatccaaacatagcgaaatgttcatgagaaggatcaagtggtttggaaacatagtactaatggtgtttatacagttcatggaatccttgatagataatttaaaggttgctggaaattggatgaaggtgtggagattaaatattcttccaaaaataaagcgttttatttggagagtgttgtgtggttgtctcccctgtaggcaaaagcttcgatgtaaaggagttcaatgtccaataacctatgctttctatccctcgattattgaaaatgaatgacacattttatttggttgaaatcaagaaataagcatgtggcaagcaacgggtatttgacaattcatagaacaaaaggtgaatgcagcaaaagaattaatgaactccttttcgatctacttggatcactacatggagatattatcaacaaatttgatgttactttatggagcagttggaattcttggaatgacaagatatgaaatgaacataccaaccctcctcttgtttctgtttcggtttctatgcagtattttgttgaatggcaaagtgcaaggtaatatgctcctcaacatcaattaacaaatgttcatgacatctcttaccagctccaacttggggacgtttgacaaacaccaccgtcaagtttccttaaatgcaacattaatgttgctcatttcaaggaggagaatagttttggtgtcggcatgatactccatcaaggaagattcgtcaaagctcactcacgttttcgacatgggtcgacatgggttacctgacccaaaggctgaggcttaggcttgggtttgcttcaagtattgatctgggcccagactattggtttacataatatcatttttgaaaacctaacatctaaaactcaaggttgtttagaggtgcgccattccaaaataagattatcctatttgtgcatgaatgcgaccaactatctcctgtttcagcattataaagtataaacaacaaacttctttaatcaagggactaaaagatattggacatacaagctaaaagtgatagaatttgagaaaacaaatattgacaacaatattcaagaggacactaaaacataattctcaaattttttttgtttatttaaaataaagtggttcattaggtagctccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagatggcccaagtgagcagagtgcacaatcttgctcaaagcactcaaatttttggccattcttccaactccaacaaactcaaatcggtgaattcggtttcattgaggccacgcctttggggggcctcaaaatctcgcatcccgatgcataaaaatggaagctttatgggaaattttaatgtggggaagggaaattccggcgtgtttaaggtttctgcatcggtcgccgccgcagagaagccgtcaacgtcgccggagatcgtgttggaacccatcaaagacttctcgggtaccatcacattgccagggtccaagtctctgtccaatcgaattttgcttcttgctgctctctctgaggtgaagtttatttatttatttatttgtttgtttgttgttgggtgtgggaataggagtttgatgtgtagagtggattttgaatatttgatttttttttgtattattctgtgaaaatgaagcatcatgtcccatgaaagaaatggacacgaaattaagtggcttatgatgtgaaatgaggatagaaatgtgtgtagggttttttaatgggtagcaataagcatattcaatatctggattgatttggacgtttctgtataaaggagtatgctagcaatgtgttaatgtatggcttgctaaaatactcctaaaaatcaagtgggagtagtatacatatctacagcaaatgtattaggtgaggcatttggcttctctattgtaaggaacaaataatatcagttaatgtgaaaatcaatggttgatattccaatacattcatgatgtgttatttatatgtacctaatattgactgttgtttttctccgcaatgaccaagattatttattttatcctctaaagtgactaattgagttgcttactttagagaagttggacccattaggtgagagcgtggggggaactaatcttgaatatacaatctgagtcttgattatccaagtatggttgtatgaacaatgttagctctagaagataaaccctcccccaaaacacaaattagaatgacatttcaagttccatgtatgtcactttcattctattatttttacaacttttagttacttaacagatgtcttgttcagcataaattataatttattctgtttttttttagggaacaactgttgtagacaacttgttgtatagtgaggatattcattacatgcttggtgcattaaggacccttggactgcgtgtggaagatgacaaaacaaccaaacaagcaattgttgaaggctgtgggggattgtttcccactagtaaggaatctaaagatgaaatcaatttattccttggaaatgctggtattgcaatgagatctttgacagcagctgttgttgctgcaggtggaaatgcaaggtctgttttttttttttttgttcagcataatctttgaattgttcctcgtataactaatcacaacagagtacgtgttcttcttcctgttataatctaaaaatctcatccagattagtcatcctttcttcttaaaaggaacctttaattatcaatgtatttatttaatatttaaattagcttgtcaaagtctagcatatacatattttgattatattctgagaaatgcacctgagggtgttcctcatgatctacttcaacctctgttattattagattttctatcatgattactggtttgagtctctaagtagaccatcttgatgttcaaaatatttcagctacgtacttgatggggtgccccgaatgagagagaggccaattggggatttggttgctggtcttaagcaacttggtgcagatgttgattgctttcttggcacaaactgtccacctgttcgtgtaaatgggaagggaggacttcctggcggaaaggtatggtttggatttcatttagaataaggtggagtaactttcctggatcaaaattctaatttaagaagcctccctgttttcctctctttagaataagactaagggtaggtttaggagttgggttttggagagaaatggaagggagagcaatttttttcttcttctaataaatattctttaatttgatacattttttaagtaaaagaatataaagatagattagcataacttaatgttttaatcttttatttatttttataaatattatatacctgtctatttaaaaatcaaatatttgtcctccattccctttcccttcaaaacctcagttccaaatataccgtagttgaattatattttggaaggcctattggttggagacttttccttttcagagattatccctcacctttattatagcctttctatttttaaacttcatatagacgccattcttggggcggccgcgat

SEQ ID NO: 508 - DNA, 32 bp, synthetic construct
  misc_feature 1..32: note = synthesized sequence- primer, soy1-F4
  source 1..32: mol_type = other DNA
tcaataatactactctcttagacaccaaacaa

SEQ ID NO: 509 - DNA, 23 bp, synthetic construct
  misc_feature 1..23: note = synthesized sequence- primer, soy1-R4
  source 1..23: mol_type = other DNA
caaggaaaatgaatgatggcttt

SEQ ID NO: 510 - DNA, 18 bp, synthetic construct
  misc_feature 1..18: note = synthesized sequence- probe, soy1-T3(FAM-MGB)
  source 1..18: mol_type = other DNA
ccttcccaaactataatc

SEQ ID NO: 511 - DNA, 27 bp, synthetic construct
  misc_feature 1..27: note = synthesized sequence- WOL1005, Forward_primer
  source 1..27: mol_type = other DNA
aaatgttatcagaggaacatgagctgc

SEQ ID NO: 512 - DNA, 28 bp, synthetic construct
  misc_feature 1..28: note = synthesized sequence- WOL1006, Reverse_primer
  source 1..28: mol_type = other DNA
attatttttccgtacatgatgtaaccgc

SEQ ID NO: 513 - DNA, 438 bp, Cauliflower mosaic virus
  source 1..438: mol_type = genomic DNA
cccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgat

SEQ ID NO: 514 - DNA, 19 bp, Cauliflower mosaic virus
  source 1..19: mol_type = genomic DNA
gtctcagaagaccaaaggg

SEQ ID NO: 515 - DNA, 25 bp, Cauliflower mosaic virus
  source 1..25: mol_type = genomic DNA
tgccatcattgcgataaaggaaagg

SEQ ID NO: 516 - DNA, 20 bp, Cauliflower mosaic virus
  source 1..20: mol_type = genomic DNA
gatgcctctgccgacagtgg

SEQ ID NO: 517 - DNA, 3708 bp, Zea mays
  source 1..3708: mol_type = genomic DNA
ctgcagcccatcaaggagatctccggcaccgtcaagctgccggggtccaagtcgctttccaacaggatcctcctgctcgccgccctgtccgaggtgagcgattttggtgcttgctgcgctgccctgtctcactgctacctaaatgttttgcctgtcgaataccatggattctcggtgtaatccatctcacgatcagatgcaccgcatgtcgcatgcctagctctctctaatttgtctagtagtttgtatacggattaagattgataaatcggtaccgcaaaagctaggtgtaaataaacactacaaaattggatgttcccctatcggcctgtactcggctactcgttcttgtgatggcatgttatttcttcttggtgtttggtgaactcccttatgaaatttgggcgcaaagaaatcgccctcaagggttgatcttatgccatcgtcatgataaacagtgaagcacggatgatcctttacgttgtttttaacaaactttgtcagaaaactagcaatgttaacttcttaatgatgatttcacaacaaaaaaggtaaccttgctactaacataacaaaagacttgttgcttattaattatatgtttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctagagaggaagtgcagctcttcttggggaatgctggaatcgcaatgcggtcattgacagcagctgttactgctgctggtggaaatgcaacgtatgtttcctctctctctctacaatacttgttggagttagtatgaaacccatgtgtatgtctagtggcttatggtgtattggtttttgaacttcagttacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggttagttactaagggccacatgttacattcttctgtaaatggtacaactattgtcgagcttttgcatttgtaaggaaaacattgattgatctgaatttgatgctacaccacaaaatatctacaaatggtcatccctaactagcaaaccatgtctccattaagctcaatgaagtaatacttggcatgtgtttatcaacttaatttccatcttctggggtattgcctgttttctagtctaatagcatttgtttttagaattagctcttacaactgttatgttctacaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtaagctctgtaatgtatttcactactttgatgccaatgtttcagttttcagttttccaaacagtcgcatcaatatttgaatagatgcactgtagaaaaaaatcattgcagggaaaaactagtactgagtattttgactgtaaattatttaaccagtcggaatatagtcagtctattggagtcaagagcgtgaaccgaaatagccagttaattatcccattatacagaggacaaccatgtatactattgaaacttggtttaagagaatctaggtagctggactcgtagctgcttggcatggataccttcttatctttaggaaaagacacttgattttttttctgtggccctctatgatgtgtgaacctgcttctctattgctttagaaggatatatctatgtcgttatgcaacatgcttcccttagtcatttgtactgaaatcagtttcataagttcgttagtggttccctaaacgaaaccttgtttttctttgcaatcaacaggtcccctaaaaatgcctatgttgaaggtgatgcctcaagcgcaagctatttcttggctggtgctgcaattactggagggactgtgactgtggaaggttgtggcaccaccagtttgcaggtaaagatttcttggctggtgctacgataactgcttttgtctttttggtttcagcattgttctcagagtcactaaataacattatcatctgcaaacgtcaaatagacatacttaggtgaatggatattcatgtaaccgtttccttacaaatttgctgaaacctcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacggtaaaacattctcagccctacaaccatgcctcttctacatcactacttgacaagactaaaaactattggctcgttggcagtggcttcctggagagtaaaggagaccgagaggatggttgcgatccggacggagctaaccaaggtaaggctacatacttcacatgtctcacgtcgtctttccatagctcgctgcctcttagcggcttgcctgcggtcgctccatcctcggttgctgtctgtgttttccacagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtgaccatccgggaccctgggtgcacccggaagaccttccccgactacttcgatgtgctgagcactttcgtcaagaattaataaagcgtgcgatactaccacgcagcttgattgaagtgataggcttgtgctgaggaaatacatttcttttgttctgttttttctctttcacgggattaagttttgagtctgtaacgttagttgtttgtagcaagtttctatttcggatcttaagtttgtgcactgtaagccaaatttcatttcaagagtggttcgttggaataataagaataataaattacgtttcagtggctgtcaagcctgctgctacgttttaggagatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccatgtatagtatgttctttctttgagtctcatttaactacctctacacataccaactttagttttttttctacctcttcatgttactatggtgccttcttatcccactgagcattggtatatttagaggtttttgttgaacatgcctaaatcatctcaatcaacgatggacaatcttttcttcgattgagctgaggtacgtcatctaga

SEQ ID NO: 518 - DNA, 3714 bp, Zea mays
  source 1..3714: mol_type = genomic DNA
ctgcagcccatcaaggagatctccggcaccgtcaagctgccggggtccaagtcgctttccaacaggatcctcctgctcgccgccctgtccgaggtgagcgattttggtgcttgctgcgctgccctgtctcactgctacctaaatgttttgcctgtcgaataccatggattctcggtgtaatccatatctgcacgatcagatatgcaccgcatgtcgcatatctgagctctctctaatttgtctagtagtttgtatacggattaagattgataaatcggtaccgcaaaagctaggtgtaaataaacactacaaaattggatgttcccctatcggcctgtactcggctactcgttcttgtgatggcatgttatttcttcttggtgtttggtgaactcccttatgaaatttgggcgcaaagaaatcgccctcaagggttgatcttatgccatcgtcatgataaacagtgaagcacggatgatcctttacgttgtttttaacaaactttgtcagaaaactagcaatgttaacttcttaatgatgatttcacaacaaaaaaggtaaccttgctactaacataacaaaagacttgttgcttattaattatatgtttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctaaagaggaagtgcagctcttcttggggaatgctggaatcgcaatgcggtcattgacagcagctgttactgctgctggtggaaatgcaacgtatgtttcctctctctctctacaatacttgttggagttagtatgaaacccatgtgtatgtctagtggcttatggtgtattggtttttgaacttcagttacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggttagttactaagggccacatgttacattcttctgtaaatggtacaactattgtcgagcttttgcatttgtaaggaaaacattgattgatctgaatttgatgctacaccacaaaatatctacaaatggtcatccctaactagcaaaccatgtctccattaagctcaatgaagtaatacttggcatgtgtttatcaacttaatttccatcttctggggtattgcctgttttctagtctaatagcatttgtttttagaattagctcttacaactgttatgttctacaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtaagctctgtaatgtatttcactactttgatgccaatgtttcagttttcagttttccaaacagtcgcatcaatatttgaatagatgcactgtagaaaaaaatcattgcagggaaaaactagtactgagtattttgactgtaaattatttaaccagtcggaatatagtcagtctattggagtcaagagcgtgaaccgaaatagccagttaattatcccattatacagaggacaaccatgtatactattgaaacttggtttaagagaatctaggtagctggactcgtagctgcttggcatggataccttcttatctttaggaaaagacacttgattttttttctgtggccctctatgatgtgtgaacctgcttctctattgctttagaaggatatatctatgtcgttatgcaacatgcttcccttagtcatttgtactgaaatcagtttcataagttcgttagtggttccctaaacgaaaccttgtttttctttgcaatcaacaggtcccctaaaaatgcctatgttgaaggtgatgcctcaagcgcaagctatttcttggctggtgctgcaattactggagggactgtgactgtggaaggttgtggcaccaccagtttgcaggtaaagatttcttggctggtgctacgataactgcttttgtctttttggtttcagcattgttctcagagtcactaaataacattatcatctgcaaacgtcaaatagacatacttaggtgaatggatattcatgtaaccgtttccttacaaatttgctgaaacctcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacggtaaaacattctcagccctacaaccatgcctcttctacatcactacttgacaagactaaaaactattggctcgttggcagtggcttcctggagagtaaaggagaccgagaggatggttgcgatccggacggagctaaccaaggtaaggctacatacttcacatgtctcacgtcgtctttccatagctcgctgcctcttagcggcttgcctgcggtcgctccatcctcggttgctgtctgtgttttccacagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtgaccatccgggaccctgggtgcacccggaagaccttccccgactacttcgatgtgctgagcactttcgtcaagaattaataaagcgtgcgatactaccacgcagcttgattgaagtgataggcttgtgctgaggaaatacatttcttttgttctgttttttctctttcacgggattaagttttgagtctgtaacgttagttgtttgtagcaagtttctatttcggatcttaagtttgtgcactgtaagccaaatttcatttcaagagtggttcgttggaataataagaataataaattacgtttcagtggctgtcaagcctgctgctacgttttaggagatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccatgtatagtatgttctttctttgagtctcatttaactacctctacacataccaactttagttttttttctacctcttcatgttactatggtgccttcttatcccactgagcattggtatatttagaggtttttgttgaacatgcctaaatcatctcaatcaacgatggacaatcttttcttcgattgagctgaggtacgtcatctaga

SEQ ID NO: 519 - DNA, 3708 bp, Zea mays
  source 1..3708: mol_type = genomic DNA
ctgcagcccatcaaggagatctccggcaccgtcaagctgccggggtccaagtcgctttccaacaggatcctcctgctcgccgccctgtccgaggtgagcgattttggtgcttgctgcgctgccctgtctcactgctacctaaatgttttgcctgtcgaataccatggattctcggtgtaatccatctcacgatcagatgcaccgcatgtcgcatgcctagctctctctaatttgtctagtagtttgtatacggattaagattgataaatcggtaccgcaaaagctaggtgtaaataaacactacaaaattggatgttcccctatcggcctgtactcggctactcgttcttgtgatggcatgttatttcttcttggtgtttggtgaactcccttatgaaatttgggcgcaaagaaatcgccctcaagggttgatcttatgccatcgtcatgataaacagtgaagcacggatgatcctttacgttgtttttaacaaactttgtcagaaaactagcaatgttaacttcttaatgatgatttcacaacaaaaaaggtaaccttgctactaacataacaaaagacttgttgcttattaattatatgtttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctagaaaggaagtgcagctcttcttggggaatgctggaatcgcaatgcggtcattgacagcagctgttactgctgctggtggaaatgcaacgtatgtttcctctctctctctacaatacttgttggagttagtatgaaacccatgtgtatgtctagtggcttatggtgtattggtttttgaacttcaggtacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggttagttactaagggccacatgttacattcttctgtaaatggtacaactattgtcgagcttttgcatttgtaaggaaaacattgattgatctgaatttgatgctacaccacaaaatatctacaaatggtcatccctaactagcaaaccatgtctccattaagctcaatgaagtaatacttggcatgtgtttatcaacttaatttccatcttctggggtattgcctgttttctagtctaatagcatttgtttttagaattagctcttacaactgttatgttctacaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtaagctctgtaatgtatttcactactttgatgccaatgtttcagttttcagttttccaaacagtcgcatcaatatttgaatagatgcactgtagaaaaaaatcattgcagggaaaaactagtactgagtattttgactgtaaattatttaaccagtcggaatatagtcagtctattggagtcaagagcgtgaaccgaaatagccagttaattatcccattatacagaggacaaccatgtatactattgaaacttggtttaagagaatctaggtagctggactcgtagctgcttggcatggataccttcttatctttaggaaaagacacttgattttttttctgtggccctctatgatgtgtgaacctgcttctctattgctttagaaggatatatctatgtcgttatgcaacatgcttcccttagtcatttgtactgaaatcagtttcataagttcgttagtggttccctaaacgaaaccttgtttttctttgcaatcaacaggtcccctaaaaatgcctatgttgaaggtgatgcctcaagcgcaagctatttcttggctggtgctgcaattactggagggactgtgactgtggaaggttgtggcaccaccagtttgcaggtaaagatttcttggctggtgctacgataactgcttttgtctttttggtttcagcattgttctcagagtcactaaataacattatcatctgcaaacgtcaaatagacatacttaggtgaatggatattcatgtaaccgtttccttacaaatttgctgaaacctcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacggtaaaacattctcagccctacaaccatgcctcttctacatcactacttgacaagactaaaaactattggctcgttggcagtggcttcctggagagtaaaggagaccgagaggatggttgcgatccggacggagctaaccaaggtaaggctacatacttcacatgtctcacgtcgtctttccatagctcgctgcctcttagcggcttgcctgcggtcgctccatcctcggttgctgtctgtgttttccacagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtgaccatccgggaccctgggtgcacccggaagaccttccccgactacttcgatgtgctgagcactttcgtcaagaattaataaagcgtgcgatactaccacgcagcttgattgaagtgataggcttgtgctgaggaaatacatttcttttgttctgttttttctctttcacgggattaagttttgagtctgtaacgttagttgtttgtagcaagtttctatttcggatcttaagtttgtgcactgtaagccaaatttcatttcaagagtggttcgttggaataataagaataataaattacgtttcagtggctgtcaagcctgctgctacgttttaggagatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccatgtatagtatgttctttctttgagtctcatttaactacctctacacataccaactttagttttttttctacctcttcatgttactatggtgccttcttatcccactgagcattggtatatttagaggtttttgttgaacatgcctaaatcatctcaatcaacgatggacaatcttttcttcgattgagctgaggtacgtcatctaga

SEQ ID NO: 520 - protein, 464 aa, Zea mays
MQLDLNVAEAPPPVEMEASDSGSSVLNASEAASAGGAPAPAEEGSSSTPAVLEFSILIRSDSDAAGADEDEDATPSPPPRHRHQHQQQLVTRELFPAGAGPPAPTPRHWAELGFFRADLQQQQAPGPRIVPHPHAAPPPAKKSRRGPRSRSSQYRGVTFYRRTGRWESHIWDCGKQVYLGGFDTAHAAARAYDRAAIKFRGVDADINFNLSDYEDDMKQMGSLSKEEFVHVLRRQSTGFSRGSSRYRGVTLHKCGRWEARMGQFLGKKYIYLGLFDSEVEAARAYDKAAIKCNGREAVTNFEPSTYHGELPTEVADVDLNLSISQPSPQRDKNSCLGLQLHHGPFEGSELKKTKIDDAPSELPGRPRQLSPLVAEHPPAWPAQPPHPFFVFTNHEMSASGDLHRRPAGAVPSWAWQVAAAAPPPAALPSSAAASSGFSNTATTAATTAPSASSLRYCPPPPPPS

SEQ ID NO: 521 - DNA, 1413 bp, Zea mays
  source 1..1413: mol_type = genomic DNA
atgcagttggatctgaacgtggccgaggcgccgccgccggtggagatggaggcgagcgactcggggtcgtcggtgctgaacgcgtcggaagcggcgtcggcgggcggcgcgcccgcgccggcggaggagggatctagctcaacgccggccgtgctggagttcagcatcctcatccggagcgatagcgacgcggccggcgcggacgaggacgaggacgccacgccatcgcctcctcctcgccaccgccaccagcaccagcagcagctcgtgacccgcgagctgttcccggccggcgccggtccgccggccccgacgccgcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccgctgggagtcccacatctgggattgcggcaagcaggtgtacctaggtggattcgacaccgctcacgccgctgcaagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaagtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgcaggggctgttcccagctgggcatggcaggtggcagcagcagctcctcctcctgccgccctgccgtcgtccgctgcagcatcatcaggattctccaacaccgccacgacagctgccaccaccgccccatcggcctcctccctccggtactgcccgccgccgccgccgccgtcgagccatcaccatccccgctga

SEQ ID NO: 522 - protein, 514 aa, Zea mays
MTTSTTAKQLRRVRTLGRGASGAVVWLASDEASGELVAVKSARAAGAAAQLQREGRVLRGLSSPHIVPCLGSRAAAGGEYQLLLEFAPGGSLADEAARSGGGRLAERAIGAYAGDVARGLAYLHGRSLVHGDVKARNVVIGGDGRARLTDFGCARPAGGSTRPVGGTPAFMAPEVARGQEQGPAADVWALGCMVVELATGRAPWSDVEGDDLLAALHRIGYTDDVPEVPAWLSPEAKDFLAGCFERRAAARPTAAQPAAHPFVVASASAAAAIRGPAKQEVVPSPKSTLHDAFWDSDAEDEADEMSTGAAAERIGALACAASALPDWDTEEGWIDLQDDHSAGTADAPPAPVADYFISWAEPSDAELEPFVAVAAAAGLPHVAGVALAGATAVNLQGSYYYYPPMHLGVRGNEIPRPLLDHHGDGLEKGQGSHRVCNRETEKVTMKRISLKRRAAFLLDQHHVRSLDKLEYRPRHDRMLRRRQSIYRSNSVLGYDVSKGRQVRWRRAVCIAVAA

SEQ ID NO: 523 - DNA, 1545 bp, Zea mays
  source 1..1545: mol_type = genomic DNA
atgacgacgtcgaccacggcgaagcagctccggcgcgtgcgcacgctcggccgcggcgcgtcgggcgccgtggtgtggctggcctccgacgaggcctcgggcgagctggtggcggtcaagtcggcgcgcgccgccggggccgcggcgcagctgcagcgcgagggccgcgtcctccggggcctctcgtcgccgcacatcgtgccctgcctcggctcccgcgccgcggcgggcggcgagtaccagctcctgctggagttcgcgccgggcgggtcgctggccgacgaggccgccaggagcggcgggggccgcctcgcggagcgcgccatcggcgcctacgccggggacgtggcgcgcgggctggcgtacctccacggccggtcgctcgtgcacggggacgtcaaggcccggaacgtggtcatcggcggcgacgggcgcgccaggctgaccgacttcgggtgcgcgaggccggccggcgggtcgacgcgccccgtcgggggcaccccggcgttcatggcgcccgaggtggcgcgcggccaggagcagggccccgccgccgacgtctgggcgctcgggtgcatggtcgtcgagctggccacgggccgcgcgccctggagcgacgtggagggcgacgacctcctcgccgcgctccaccggatcgggtacacggacgacgtgccggaggtgcccgcgtggctgtcgcccgaggccaaggacttcctggccggctgcttcgagcgccgcgccgccgcccggcccacggccgcgcagcccgcggcgcacccgttcgtcgtcgcctccgcctccgccgccgccgccatccgcggcccggcgaagcaggaggtggtcccgtcacccaagagcacgctgcacgacgcgttctgggactcggacgccgaggacgaagcggacgagatgtcgacgggcgcggcggccgagaggatcggggcattggcgtgcgccgcctccgcgctgcctgactgggacaccgaggaaggctggatcgacctccaggacgaccactcggccggaactgccgacgcaccgccggcgcccgtcgcggactacttcatcagctgggcggagccgtcagacgcagagctggaaccattcgtcgccgtcgccgccgccgcaggtctcccgcacgttgcaggagttgcattagcaggcgccaccgccgttaacctgcagggcagttattattattacccgcctatgcatctaggcgtccgcggaaacgagattccacgcccgttgttggatcatcatggcgacgggttagaaaaggggcagggatcccaccgcgtttgtaacagagaaacagaaaaggtaacaatgaaacgaatttcgttaaaaagaagagctgctttccttctcgaccagcatcacgtgcgatcgctggacaaactggaatatcgtccacgtcacgaccgaatgctgcgtcgacggcaatctatatatcggagcaatagcgtccttggttacgacgttagcaaaggtaggcaggtccgttggcgccgtgcggtttgcattgccgttgctgcctga

SEQ ID NO: 524 - DNA, 671 bp, Zea mays
  source 1..671: mol_type = genomic DNA
cggatccactagtaacggccgccagtgtgctggaattcgcccttgacggcccgggctggtatttcaaaactatagtattttaaaattgcattaacaaacatgtcctaattggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcgaccgtcacctgcttcaccaccggcgagccacatcgagaacacgatcgagcacacaagcacgaagactcgtttaggagaaaccacaaaccaccaagccgtgcaagcac

SEQ ID NO: 525 - protein, 245 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 526 - DNA, 738 bp, Zea mays
  source 1..738: mol_type = genomic DNA
atggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctga

SEQ ID NO: 527 - DNA, 80 bp, Zea mays
  misc_feature 1..80: note = sequence of Figure 34B
  source 1..80: mol_type = genomic DNA
gctaaagaggaagtgcagctcttcttggggaatgctggaactgcaatgcggccattgacagcagctgttactgctgctgg

SEQ ID NO: 528 - DNA, 80 bp, Zea mays
  misc_feature 1..80: note = sequence of Figure 34c
  source 1..80: mol_type = genomic DNA
gctagagaggaagtgcagctcttcttggggaatgctggaatcgcaatgcggtcattgacagcagctgttactgctgctgg

SEQ ID NO: 529 - DNA, 37 bp, Zea mays
  misc_feature 1..37: note = sequence of Figure 35b
  source 1..37: mol_type = genomic DNA
catctcacgatcagatgcaccgcatgtcgcatgccta

SEQ ID NO: 530 - DNA, 42 bp, Zea mays
  misc_feature 1..42: note = sequence of Figure 35c
  source 1..42: mol_type = genomic DNA
catatctgcacgatcagatatgcaccgcatgtcgcatatctg

SEQ ID NO: 531 - DNA, 31 bp, Zea mays
  misc_feature 1..31: note = sequence of Figure 37
  source 1..31: mol_type = genomic DNA
gtttttgaacttcagttacgtgcttgatgga

SEQ ID NO: 532 - DNA, 31 bp, Zea mays
  misc_feature 1..31: note = sequence of Figure 37
  source 1..31: mol_type = genomic DNA
gtttttgaacttcaggtacgtgcttgatgga

SEQ ID NO: 533 - DNA, 459 bp, synthetic construct
  misc_feature 1..459: note = synthesized sequence- Southern genomic probe
  source 1..459: mol_type = other DNA
agctttatccatccatccatcgcgctagctggctgcaggcacgggttatcttatcttgtcgtccagaggacgacacacggccggccggtgaagtaaaagggagtaatcttattttgccaggacgaggggcggtacatgatattacacacgtaccatgcatgcatatatgcatggacaaggtacgtcgtcgtcgatcgacgtcgatgcatatgtgtgtatgtatgtacgtgcataatgcatggtaccagctgctggcttatatatatttgtcaccgatcgatgcatgctgctgctctacacggtttgacactttaatttgactcatcgatgaccttgctagatagtagcggctcgtcaattaatgagccatcaagttaacaagagggcacgggcttgcgcgactgattccaccttattaacatacgccctgcgcccgcgcgtgctgtacgtacgagaatt

SEQ ID NO: 534 - DNA, 446 bp, synthetic construct
  misc_feature 1..446: note = synthesized sequence- Southern MoPAT probe
  source 1..446: mol_type = other DNA
tcgaagtcgcgctgccagaagccgacgtcgtgccagccgccgtgcttgtagccggcggcgcggagggtgccgcgggcggtgtagccgagggcctcgtggaggcgcacggacgggtcgttcgggaggccgatcacggccaccacggacttgaagccctgggcctccatgctcttgaggaggtgggtgtagagggtggagccgaggccgaggcgctggtggcggtgggacacgtacacggtggactccacggtccagtcgtaggcgttgcgggccttccacgggccggcgtaggcgatgccggccaccacgccctccacctcggccacgagccacgggtagcggtcctggaggcgctccaggtcgtcgatccactcctgcggggtctgcggctcggtgcggaagttcacggtggaggtctcgatgtagtggttcacgatgtcgcacac

SEQ ID NO: 535 - DNA, 20 bp, synthetic construct
  misc_feature 1..20: note = synthesized sequence- RF-FPCas-1
  source 1..20: mol_type = other DNA
gcaggtctcacgacggttgg

SEQ ID NO: 536 - DNA, 23 bp, synthetic construct
  misc_feature 1..23: note = synthesized sequence- RF-FPCas-2
  source 1..23: mol_type = other DNA
gtaaagtacgcgtacgtgtgagg

SEQ ID NO: 537 - DNA, 23 bp, synthetic construct
  misc_feature 1..23: note = synthesized sequence- ALSCas-4
  source 1..23: mol_type = other DNA
gctgctcgattccgtccccatgg

SEQ ID NO: 538 - DNA, 804 bp, synthetic construct
  misc_feature 1..804: note = synthesized sequence- ALS modification repair template 804
  source 1..804: mol_type = other DNA
agcttacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgttgctcgactccgtccccattgtcgccatcacgggacaggtgtcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcagaagggcg

SEQ ID NO: 539 - DNA, 127 bp, synthetic construct
  misc_feature 1..127: note = synthesized sequence- ALS modification repair template 127
  source 1..127: mol_type = other DNA
aaccttgtctccgcgctcgccgacgcgttgctcgactccgtccccattgtcgccatcacgggacaggtgtcgcgacgcatgattggcaccgacgccttccaggagacgcccatcgtcgaggtcaccc

SEQ ID NO: 540 - DNA, 25 bp, synthetic construct
  misc_feature 1..25: note = synthesized sequence- ALS Forward_primer;
  source 1..25: mol_type = other DNA
ctacgcacatccccctttctcccac

SEQ ID NO: 541 - DNA, 36 bp, synthetic construct
  misc_feature 1..36: note = synthesized sequence- ALS Reverse_primer
  source 1..36: mol_type = other DNA
atgcatacctagcatgcgcagagacagtgggtcgtc

SEQ ID NO: 542 - DNA, 22 bp, Glycine max
  source 1..22: mol_type = genomic DNA
caccggccaggtcccccgccgg

SEQ ID NO: 543 - DNA, 22 bp, Glycine max
  source 1..22: mol_type = genomic DNA
ggcgtcggtgccgatcatccgg

SEQ ID NO: 544 - DNA, 9093 bp, synthetic construct
  misc_feature 1..9093: note = synthesized sequence- QC880
  source 1..9093: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgcaccggccaggtcccccgcgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccggtac

SEQ ID NO: 545 - DNA, 9093 bp, synthetic construct
  misc_feature 1..9093: note = synthesized sequence- QC881
  source 1..9093: mol_type = other DNA
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgggcgtcggtgccgatcatcgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccggtac

SEQ ID NO: 546 - DNA, 1113 bp, synthetic construct
  misc_feature 1..1113: note = synthesized sequence- RTW1026A
  source 1..1113: mol_type = other DNA
agcttggtaccgagctcggatccactagtatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcagccgtcgcatgatcggtaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactggga

SEQ ID NO: 547 - DNA, 17 bp, synthetic construct
  misc_feature 1..17: note = synthesized sequence- WOL900, Forward_primer
  source 1..17: mol_type = other DNA
atcaccggccaggtcag

SEQ ID NO: 548 - DNA, 25 bp, synthetic construct
  misc_feature 1..25: note = synthesized sequence- WOL578, Reverse_primer
  source 1..25: mol_type = other DNA
acttaccctccactcctttctcctc

SEQ ID NO: 549 - DNA, 29 bp, synthetic construct
  misc_feature 1..29: note = synthesized sequence- WOL573, Forward_primer
  source 1..29: mol_type = other DNA
atggcggccaccgcttccagaaccacccg

SEQ ID NO: 550 - protein, 638 aa, Zea mays
MATAAAASTALTGATTAAPKARRRAHLLATRRALAAPIRCSAASPAMPMAPPATPLRPWGPTEPRKGADILVESLERCGVRDVFAYPGGASMEIHQALTRSPVIANHLFRHEQGEAFAASGYARSSGRVGVCIATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPVWDKPMSLPGYIARLPKPPATELLEQVLRLVGESRRPVLYVGGGCAASGEELRRFVELTGIPVTTTLMGLGNFPSDDPLSLRMLGMHGTVYANYAVDKADLLLALGVRFDDRVTGKIEAFASRAKIVHVDIDPAEIGKNKQPHVSICADVKLALQGMNALLEGSTSKKSFDFGSWNDELDQQKREFPLGYKTSNEEIQPQYAIQVLDELTKGEAIIGTGVGQHQMWAAQYYTYKRPRQWLSSAGLGAMGFGLPAAAGASVANPGVTVVDIDGDGSFLMNVQELAMIRIENLPVKVFVLNNQHLGMVVQWEDRFYKANRAHTYLGNPENESEIYPDFVTIAKGFNIPAVRVTKKNEVRAAIKKMLETPGPYLLDIIVPHQEHVLPMIPSGGAFKDMILDGDGRTVY

SEQ ID NO: 551 - DNA, 23 bp, Glycine max
  source 1..23: mol_type = genomic DNA
gtgtttggaacccttgagagagg

SEQ ID NO: 552 - DNA, 22 bp, Glycine max
  source 1..22: mol_type = genomic DNA
caaagccaccattcactgttgg

SEQ ID NO: 553 - DNA, 9174 bp, synthetic construct
  misc_feature 1..9174: note = synthesized sequence RTW1211
  source 1..9174: mol_type = other DNA
atgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgctcgggcgcgccggtacccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtgtttggaacccttgagaggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagct

SEQ ID NO: 554 - DNA, 9174 bp, synthetic construct
  misc_feature 1..9174: note = synthesized sequence RTW1212
  source 1..9174: mol_type = other DNA
tgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgctcgggcgcgccggtacccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgcaaagccaccattcactgtgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgatatcaagcttatcgataccgtcgagggggggcccggtaccggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcg

SEQ ID NO: 555 - DNA, 43 bp, Zea mays
  source 1..43: mol_type = genomic DNA
gatatatatacctcacacgtacgcgtacgcgtatatatacgtg

SEQ ID NO: 556 - DNA, 43 bp, Zea mays
  source 1..43: mol_type = genomic DNA
cacgtatatatacgcgtacgcgtacgtgtgaggtatatatatc

SEQ ID NO: 557 - DNA, 104 bp, synthetic construct; identical to SEQ ID NO: 121
  misc_feature 1..104: note = synthesized sequence- sequence of Figure
  source 1..104: mol_type = other DNA

SEQ ID NO: 558 - DNA, 70 bp, Glycine max; identical to SEQ ID NO: 129
  source 1..70: mol_type = genomic DNA

SEQ ID NO: 559 - DNA, 70 bp, Glycine max; identical to SEQ ID NO: 130
  source 1..70: mol_type = genomic DNA

SEQ ID NO: 560 - DNA, 70 bp, Glycine max; identical to SEQ ID NO: 131
  source 1..70: mol_type = genomic DNA

SEQ ID NO: 561 - DNA, 70 bp, Glycine max; identical to SEQ ID NO: 132
  source 1..70: mol_type = genomic DNA

SEQ ID NO: 562 - protein, 8 aa, Zea mays
VEDAKEEV

SEQ ID NO: 563 - protein, 8 aa, Petunia hybrida
GKESKEEI

SEQ ID NO: 564 - protein, 8 aa, Solanum lycopersicum
GKKSEEEI

SEQ ID NO: 565 - protein, 8 aa, Sorghum bicolor
EKDAKEEV

SEQ ID NO: 566 - protein, 8 aa, Oryza sativa
VEDSKEEV

SEQ ID NO: 567 - protein, 8 aa, Amaranthus floridanus
GKDGKEEI

SEQ ID NO: 568 - DNA, 80 bp, Zea mays; identical to SEQ ID NO: 527
  source 1..80: mol_type = genomic DNA

SEQ ID NO: 569 - DNA, 80 bp, Zea mays; identical to SEQ ID NO: 528
  source 1..80: mol_type = genomic DNA

SEQ ID NO: 570 - DNA, 37 bp, Zea mays; identical to SEQ ID NO: 529
  source 1..37: mol_type = genomic DNA

SEQ ID NO: 571 - DNA, 42 bp, Zea mays; identical to SEQ ID NO: 530
  source 1..42: mol_type = genomic DNA

That which is claimed:

1. A method for introducing a polynucleotide of interest into a plant genome without introducing an exogenous selectable marker into said plant genome, the method comprising providing a first guide RNA, a first polynucleotide modification template, a second guide RNA, a second polynucleotide modification template, and a Cas endonuclease to a plant cell comprising a first endogenous gene comprises an enolpyruvylshikimate-3-phosphate synthase (EPSPS) gene, wherein said first guide RNA and Cas endonuclease are capable of forming a first complex that enables the Cas endonuclease to introduce a double strand break at a first target site located in or near said first endogenous gene in the genome of said plant cell, wherein said first polynucleotide modification template causes a deletion of the native promoter of the first endogenous gene with the insertion of a heterologous promoter and at least one nucleotide modification of said first endogenous gene to render said first endogenous gene capable of conferring herbicide resistance to a plant cell, wherein said second guide RNA and Cas endonuclease are capable of forming a second complex that enables the Cas endonuclease to introduce a double strand break at a second target site in the genome of said plant cell, wherein said second polynucleotide modification template comprises at least one polynucleotide of interest to be introduced into said plant genome, wherein the first target site and the second target site are located at two different genomic loci.

2. The method of claim 1, wherein an endogenous EPSPS gene is modified to confer glyphosate resistance.

3. The method of claim 1, wherein Cas endonuclease is a Cas9 endonuclease.

4. The method of claim 1, further comprising selecting at least one plant cell that has resistance to an herbicide and comprises said at least one polynucleotide of interest in said plant genome.

5. The method of claim 1, wherein the at least one polynucleotide of interest is selected from the group consisting of herbicide-tolerance coding sequences, insecticidal coding sequences, nematicidal coding sequences, antimicrobial coding sequences, antifungal coding sequences, antiviral coding sequences, abiotic stress tolerance coding sequences, biotic stress tolerance coding sequences, yield coding sequences, grain quality coding sequences, nutrient content coding sequences, starch quality coding sequences, starch quantity coding sequences, nitrogen fixation coding sequences, nitrogen utilization coding sequences, and oil content coding sequences.

6. The method of claim 4, wherein said herbicide is a glyphosate herbicide.

* * * * *